(12) United States Patent
Dormitzer et al.

(10) Patent No.: US 11,629,172 B2
(45) Date of Patent: Apr. 18, 2023

(54) HUMAN CYTOMEGALOVIRUS GB POLYPEPTIDE

(71) Applicant: Pfizer Inc., New York, NY (US)

(72) Inventors: Philip Ralph Dormitzer, Nyack, NY (US); Ye Che, Niantic, CT (US); Xiaoyuan Sherry Chi, Tenafly, NJ (US); Seungil Han, Mystic, CT (US); Kyle Paul Heim, Boulder, CO (US); Thomas Richard Jones, Bluffton, SC (US); Yuhang Liu, South Glastonbury, CT (US); Xiayang Qiu, Mystic, CT (US); Xinzhen Yang, Woodcliff, NJ (US); Xiaojie Yao, East Lyme, CT (US); Matthew Curtis Griffor, North Stonington, CT (US); Jennifer Anne Nicki, Gales Ferry, CT (US)

(73) Assignee: Pfizer Inc., New York, NY (US)

( * ) Notice: Subject to any disclaimer, the term of this patent is extended or adjusted under 35 U.S.C. 154(b) by 0 days.

(21) Appl. No.: 16/721,229

(22) Filed: Dec. 19, 2019

(65) Prior Publication Data

US 2020/0247853 A1 Aug. 6, 2020

Related U.S. Application Data

(60) Provisional application No. 62/784,005, filed on Dec. 21, 2018.

(51) Int. Cl.
C07K 14/005 (2006.01)
A61K 39/00 (2006.01)

(52) U.S. Cl.
CPC ............ *C07K 14/005* (2013.01); *A61K 39/00* (2013.01)

(58) Field of Classification Search
None
See application file for complete search history.

(56) References Cited

U.S. PATENT DOCUMENTS

| 5,244,805 | A | 9/1993 | Miller |
| 8,716,257 | B2 | 5/2014 | Cobbs et al. |
| 9,683,022 | B2 * | 6/2017 | Carfi .................. C07K 14/005 |
| 10,611,800 | B2 | 4/2020 | Yang et al. |
| 2002/0076813 | A1 | 6/2002 | Steaffens et al. |
| 2011/0200633 | A1 | 8/2011 | Shenk et al. |
| 2015/0359879 | A1 | 12/2015 | Wellnitz et al. |
| 2019/0127422 | A1 | 5/2019 | Yang et al. |
| 2019/0314493 | A1 * | 10/2019 | Ciaramella ........ A61K 31/7115 |
| 2022/0088184 | A1 | 3/2022 | Liu et al. |

FOREIGN PATENT DOCUMENTS

| EP | 3031822 | 6/2016 |
| WO | 1989007143 | 8/1989 |
| WO | 1991015586 | 10/1991 |
| WO | 1994000150 | 1/1994 |
| WO | 1994003620 | 2/1994 |
| WO | 1994017810 | 8/1994 |
| WO | 1995028941 | 11/1995 |
| WO | 1995031555 | 11/1995 |
| WO | 1995032213 | 11/1995 |
| WO | 1996004383 | 2/1996 |
| WO | 1996004384 | 2/1996 |
| WO | 1996039491 | 12/1996 |
| WO | 1997005262 | 2/1997 |
| WO | 1997031117 | 8/1997 |
| WO | 1997033992 | 9/1997 |
| WO | 1997040165 | 10/1997 |
| WO | 1998002746 | 1/1998 |
| WO | 1998021233 | 5/1998 |
| WO | 1998026074 | 6/1998 |
| WO | 1998045314 | 10/1998 |
| WO | 1999013075 | 3/1999 |
| WO | 1999019349 | 4/1999 |
| WO | 2000053729 | 9/2000 |
| WO | 2000075180 | 12/2000 |
| WO | 2001016153 A1 | 3/2001 |
| WO | 2011119920 A2 | 9/2001 |
| WO | 2001072782 A2 | 10/2001 |
| WO | 2002018954 A2 | 3/2002 |
| WO | 2002034769 A2 | 5/2002 |
| WO | 2002062296 A2 | 8/2002 |
| WO | 2002062956 A2 | 8/2002 |
| WO | 2002066629 A2 | 8/2002 |
| WO | 2003000720 A1 | 1/2003 |
| WO | 2003035835 A2 | 5/2003 |
| WO | 2004000873 A2 | 12/2003 |
| WO | 2004/058166 A2 | 7/2004 |
| WO | 2004055166 A2 | 7/2004 |

(Continued)

OTHER PUBLICATIONS

NCBI Accession P13201 (Year: 2021).*
Seq ID # 46 comparison (Year: 2022).*
Plotkin, S., "Vaccination Against Cytomegalovirus, the Changeling Demon", Pediatric Infectious Disease Journal, 18(4):313-326 (1999).
Plotkin, S., "The history of Vaccination Against Cytomegalovirus", Medical Microbiology & Immunology, 204(3):247-254 (2015).
Ramirez, N., et al., "Viral-Specific Adoptive Immunotherapy After allo-SCT: The role of Multimer-Based Selection Strategies", Bone Marrow Transplantation, 48(10):1265-1270 (2013).

(Continued)

*Primary Examiner* — Shanon A. Foley
*Assistant Examiner* — Myron G Hill
(74) *Attorney, Agent, or Firm* — Maria V. Marucci

(57) ABSTRACT

The present invention relates to polypeptides and cytomegalovirus (CMV) antigens that include at least one introduced amino acid mutation relative to the amino acid sequence of the wild-type HCMV glycoprotein B (gB). In some embodiments, the polypeptide is stabilized in a conformation alternative to the gB postfusion conformation. Also disclosed are compositions including the polypeptides and uses thereof.

14 Claims, 51 Drawing Sheets

Specification includes a Sequence Listing.

(56) References Cited

FOREIGN PATENT DOCUMENTS

| | | | |
|---|---|---|---|
| WO | 2004076645 A2 | 9/2004 |
| WO | 2004093905 A1 | 11/2004 |
| WO | 2004111080 A1 | 12/2004 |
| WO | 2005007689 A1 | 1/2005 |
| WO | 2005012545 A2 | 2/2005 |
| WO | 2005035771 A2 | 4/2005 |
| WO | 2005085456 A1 | 9/2005 |
| WO | 2006004661 A1 | 1/2006 |
| WO | 2006056027 A1 | 6/2006 |
| WO | 2006110728 A2 | 10/2006 |
| WO | 2007054250 A1 | 5/2007 |
| WO | 2007062832 A2 | 6/2007 |
| WO | 2007068758 A1 | 6/2007 |
| WO | 2007068907 A2 | 6/2007 |
| WO | 2007106404 A2 | 9/2007 |
| WO | 2007130470 A2 | 11/2007 |
| WO | 2007146024 A2 | 12/2007 |
| WO | 2008003327 A2 | 1/2008 |
| WO | 2008071806 A1 | 6/2008 |
| WO | 2008084410 A2 | 7/2008 |
| WO | 2008095677 A1 | 8/2008 |
| WO | 2008120203 A2 | 10/2008 |
| WO | 2008138590 A1 | 11/2008 |
| WO | 2009037359 A1 | 3/2009 |
| WO | 2009049138 A1 | 4/2009 |
| WO | 2009114560 A2 | 9/2009 |
| WO | 2009155535 A2 | 12/2009 |
| WO | 2010007463 A1 | 1/2010 |
| WO | 2010007533 A2 | 1/2010 |
| WO | 2010014567 A2 | 2/2010 |
| WO | 2010114106 A1 | 10/2010 |
| WO | 2010125201 A1 | 11/2010 |
| WO | 2010128338 A2 | 11/2010 |
| WO | 2010148541 A1 | 12/2010 |
| WO | 2011053798 A2 | 5/2011 |
| WO | 2011076883 A1 | 6/2011 |
| WO | 2011093858 A1 | 8/2011 |
| WO | 2011124371 A1 | 10/2011 |
| WO | 2011143653 A2 | 11/2011 |
| WO | 2011159938 A2 | 12/2011 |
| WO | 2012034025 A2 | 3/2012 |
| WO | 2012049317 A2 | 4/2012 |
| WO | 2012051211 A2 | 4/2012 |
| WO | 2012097105 A1 | 7/2012 |
| WO | 2012106377 A2 | 8/2012 |
| WO | 2012135177 A2 | 10/2012 |
| WO | 2012141653 A1 | 10/2012 |
| WO | 2012152644 A1 | 11/2012 |
| WO | 2012170765 A2 | 12/2012 |
| WO | 2013006838 A1 | 1/2013 |
| WO | 2013006842 A2 | 1/2013 |
| WO | 2013036465 A2 | 3/2013 |
| WO | 2013054199 A2 | 4/2013 |
| WO | 2013068847 A2 | 5/2013 |
| WO | 2013144722 A2 | 10/2013 |
| WO | 2013165982 A2 | 11/2013 |
| WO | 2014005959 A1 | 1/2014 |
| WO | 2014060594 A1 | 4/2014 |
| WO | 2014068001 A1 | 5/2014 |
| WO | 2014138086 A1 | 9/2014 |
| WO | 2014138209 A1 | 9/2014 |
| WO | 2014145932 A2 | 9/2014 |
| WO | 2014200898 A2 | 12/2014 |
| WO | 2015181142 A1 | 12/2015 |
| WO | 2016092460 A1 | 6/2016 |
| WO | 2017/109629 A1 | 6/2017 |
| WO | 2019/169120 A1 | 9/2019 |

OTHER PUBLICATIONS

Rasmussen, L., et al., "Cytomegalovirus gB Genotype Distribution Differs in Human Immunodeficiency Virus-Infected Patients and Immunocompromised Allograft Recipients", Journal of Infecious Diseases, 175(1):179-184 (1997).

Rasmussen, L., et al., "Inter- and Intragenic Variations Complicate the Molecular Epidemiology of Human Cytomegalovirus", Journal of Infectious Diseases, 187(5):809-819 (2003).

Rautenberg, P., et al., "Evaluation of the AmpliSensor PCR and the SHARP Signal Detection System for the Early Prediction of Symptomatic CMV Infection in Solid Transplant Recipients", Journal of Clinical Virology, 13(1-2):81-94 (1999).

Reschke, M., et al., "Constitutive Expression of Human Cytomegalovirus (HCMV) Glycoprotein gpUL75 (gH) in Astrocytoma Cells: a Study of the Specific Humoral Immune Response", Viral Immunology, 12(3):249-262 (1999).

Revello, M., et al., "Human Cytomegalovirus Tropism for Endothelial/Epithelial Cells: Scientific Background and Clinical Implications", Reviews in Medical Virology, 20(3):136-155 (2010).

Rieder, F., "Cytomegalovirus Vaccine: Phase II Clinical Trial Results", Clinical Microbiology & Infection, 20(5):95-102 (2014).

Rivailler, P., "Genomic Sequence of Rhesus Cyomegalovirus 180.92: Insights Into the Coding Potential of Rhesus Cytomegalovirus", J Virol., 80(8):4179-4182 (2006).

Roubalova, K., "Genetic Variability of Cytomegalovirus Glycoprotein O in Hematopoietic Stem Cell Transplant Recipients", Transplant Infectious Disease, 13(3):237-243 (2011).

Ryckman, B.J., et al., "Characterization of the Human Cytomegalovirus gH/gL/UL128-131 Complex That Mediates Entry into Epithelial and Endothelial Cells", Journal of Virology, 81(1):60-70 (2008).

Ryckman, B., et al., "Human Cytomegalovirus Entry into Epithelial and Endothelial Cells Depends on Genes UL128 to UL150 and Occurs by Endocytosis and Low-pH Fusion", Journal of Virology, 80(2):710-722 (2006).

Ryckman, B., et al., "Characterization of the Human Cytomegalovirus gH/gL/UL128-131 Complex that Mediates Entry into Epithelial and Endothelial Cells", Journal of Virology, 82(1):60-70 (2008).

Ryckmann, B., et al., "HCMV gH/ gL/ UL128-131 Interferes with Virus Entry into Epithelial Cells: Evidence for Cell Type-Specific Receptors", PNAS, 105(37):14118-14123 (2008).

Sanchez, V. et al., "Accumulation of Virion Tegument and Envelope Proteins in a Stable Cytoplasmic Compartment During Human Cytomegalovirus Replication:Ccharacterization of a Potential Site of Virus Assembly", Journal of Virology, 74(2):975-986 (2000).

Sanchez, V. et al., "Viable Human Cytomegalovirus Recombinant Virus with an Internal Deletion of the IE2 86 Gene Affects Late Stages of Viral Replication", Journal of Virology, 76(6):2973-2989 (2002).

Sandalova, E., et al., Contribution of Herpesvirus Specific CD8 T Cells to Anti-Viral T Cell Response in Humans, PLOS Pathogens, 6(8): e1001051 1-12 (2010).

Satterwhite, T., et al., "Increased Expression of Cytotoxic Effector Molecules: Different Interpretations for Steroid-Based and Steroid-Free Immunosuppression", Pediatric Transplantation, 7(1) 53-58 (2003).

Schleiss, M., "Cytomegalovirus Vaccine Development", Current Topics in Microbiology and Immunology, 325:361-382 (2008).

Schleiss, M., "Cytomegalovirus Vaccine Strategies", Expert Opinion on Therapeutic Patents, 18(4): 375-385 (2008).

Schleiss, M., et al., "Cytomegalovirus Vaccines and Methods of Production (WO20009049138): the Emerging Recognition of the Importance of Virus Neutralization at the Epithelial/Endothelial Interface", Expert Opinion on Therapeutic Patents, 20(4):597-602 (2010).

Schleiss, M., et al., "Preventing Congenital Cytomegalovirus Infection: Protection to a 'T'", Trends in Microbiology, 24(3):170-172 (2016).

Schleiss, M., "Cytomegalovirus Vaccine Under Development", Journal of Virus Eradication, 2(4): 198-207 (2016).

Schuessler, A., et al., "Charge Cluster-To-Alanine Scanning of UL128 for Fine Tuning of the Endothelial Cell Tropism of Human Cytomegalovirus", Journal of Virology, 82(22):11239-11246 (2008).

Schuessler, A., et al., "Mutational Mapping of pUL131A of Human Cytomegalovirus Emphasizes Its Central Role for Endothelial Cell Tropism", Journal of Virology, 86(1):504-512 (2012).

Schultz, E., et al., "Scanning Mutagenesis of Human Cytomegalovirus Glycoprotein gH/ gL", Journal of Virology, 90(5):2294-2305 (2015).

(56) References Cited

OTHER PUBLICATIONS

Scrivano, L. et al, "HCMV Spread and Cell Tropism are Determined by Distinct Virus Populations", PLOS Pathogen, 7(1) e1001256 1-12 (2011).
Seedah, E., et al., "Immunotherapeutic Approaches to Prevent Cytomegalovirus-Mediated Disease", Microbiology Spectrum, 2(1): 1-12 (2014).
Shi, X., Harrison RL, Hollister JR, Mohammed A, Fraser MJ Jr, Jarvis DL. Construction and characterization of new piggyBac vectorsfor constitutive or inducible expression of heterologous gene pairs and the identification of a previously unrecognized activatorsequence in piggyBac. BMC Biotechnol. 18;7:5 (2007).
Sindre, H., et al., "Human Cytomegalovirus Induced Inhibition of Hematopoietic Cell Line Growth is Initiated by Events Taking Place Before Translation of Viral Gene Products", Archives of Virology, 145(1):99-111 (2000).
Sinzger, C., et al., "Cytomegalovirus Cell Tropism", Current Topics in Microbiology & Immunology, 325:63-83 (2008).
Spear, P., et al., "Herpesvirus entry: An update", Journal of Virology, 77(19):10179-10185 (2003).
Spindler, N., et al., "Structural Basis for the Ecognition of Human Cytomegalovirus Glycoprotein B by a Neutralizing Human Antibody", PLOS Pathogens, 10(10): e1004377 1-15 (2014).
Steininger, C., et al., "Frequency Distribution and Genetic Distances of CMV Strains Found in Different Clinical Specimens From Immunocompetent and Inummocompromised Patients", Infection Genetics & Evolution, 5(3):305 (2005).
Stock, D., et al., "The Evolution of the Vertebrate D1x Gene Family", Proc. Natl. Acad. Sci, 93:10858-10863 (1996).
Straschewski, S., et al., "The Gene Region UL128-UL131A of Human Cytomegalovirus (HCMV) is Essential for Monocyte Infection and Block of Migration:Characterization of the Infection of Primary Human Monocytes", (2010).
Straschewski, S., et al., "Protein pUL128 of Human Cytomegalovirus is Necessary for Monocyte Infection and Blocking of Migration", Journal of Virology, 85(10):5150-5158 (2011).
Sung, H., et al., "Update on the Current Status of Cytomegalovirus Vaccines", Expert Review of Vaccines, 9(11):1303-1314 (2010).
Swanson, E., et al., "Comparison of Monovalent Glycoprotein B With Bivalent gB /pp65 (GP83) Vaccine for Congenital Cytomegalovirus Infection in a Guinea Pig Model: Inclusion of GP83 Reduces gB Antibody Response but Both Vaccine Approaches Provide Equivalent Protection Against Pup Mortality", Vaccine, 33(32):4013-4018 (2015).
Tang, X.C., et al., "Baculovirus-Produced Influenza Virus-Like Particles in Mammalian Cells Protect Mice from Lethal Influenza Challenge", Viral Immunology, 24(4):311-319 (2011).
Terpe, K., "Overview of Tag Protein Fusions: From Molecular and Biochemical Fundamentals to Commercial Systems", Appl Microbiol Biotechnol, 60(5):523-33 (2003).
Tischer, S., et al., "Heat Shock Protein 70/Peptide Complexes: Potent Mediators for the Generation of Antiviral T Cells Particularly with Regard to Low Precursor Frequencies", Journal of Translational Medicine 9(1): 1-14 (2011).
Vanarsdall, A., et al., "Human Cytomegalovirus Glycoproteins gB and gH/ gLmediate Epithelial Cell-Cell Fusion When Expressed Either in cis or in trans", Journal of Virology, 82(23):11837-11850 (2008).
Vanarsdall, A., et al., "Human Cytomegalovirus Glycoprotein gO Complexes With gH/ gL, Promoting Interference With Viral Entry Into Human Fibroblasts but Not Entry Into Epithelial Cells", Journal of Virology, 85(22):11638-11645 (2011).
Vanarsdall, A., et al., "PDGF Receptor-Alpha Does Not Promote HCMV Entry into Epithelial and Endothelial Cells but Increased Quantities Stimulate Entry by an Abnormal Pathway", PLOS Pathogens, 8(9):e1002905 1-15 (2012).
Vanarsdall, A., et al., "Human Cytomegalovirus Entry Into Cells", Current Opinion in Virology, 2(1):37-42 (2012).
Van Zanten, J., et al., "Humoral Immune Response Against Human Cytomegalovirus (HCMV)-Specific Proteins After HCMV Infection in Lung Transplantation as Detected With Recombinant and Naturally Occurring Proteins", Clinical & Diagnostic Laboratory Immunology, 2(2):214-218 (1995).
Vijayachandran, L., et al., "Gene Gymnastics: Synthetic Biology for Baculovirus Expression Vector System Engineering", Bioengineered, 4:(5):279-287 (2013).
Vogel, J. et al., "Model for the Evaluation of Novel antivirals to Prevent HCMV Dissemination", Antiviral Research, 50(1) A66 (2001).
Vogel, J. et al., "Role of human Cytomegalovirus genotype polymorphisms in AIDS patients with Cytomegalovirus retinitis", Medical Microbiology & Immunology 202(1):37-47 (2013).
Vomaske, J., et al., "Cytomegalovirus CC Chemokine Promotes Immune Cell Migration", Journal of Virology, 86(21):11833-11844 (2012).
Wallace, D., et al., "Human Cytomegalovirus-Specific CD8(+) T-Cell Expansions Contain Long-Lived Cells That Retain Functional Capacity in Both Young and Elderly Subjects", Immunology, 132(1):27-38 (2011).
Wang, D., et al., "Human Cytomegalovirus Virion Protein Complex Required for Epithelial and Endothelial Cell Tropism", PNAS, 102(50):18153-18158 (2005).
Wang, D., et al., "Progress on Human Cytomegalovirus Vaccines for Prevention of Congenital Infection and Disease", Current Opinion in Virology, 6(1):13-23 (2014).
Wang, X., et al., "Integrin $\alpha v\beta 3$ Is a Coreceptor for Human Cytomegalovirus", Nature Medicine, 11(5):515-521 (2005).
Wen, Y., et al., Human Cytomegalovirus gH/ gL/ UL128/UL130/ UL131A Complex Elicits Potently Neutralizing Antibodies in Mice, Vaccine, 32(30):3796-37804 (2014).
Wilkinson, G., et al., "Human Cytomegalovirus: Taking the Strain", Medical Microbiology and Immunology, 204(3):273-284 (2015).
Wille, P., et al., "A Human Cytomegalovirus gO-null Mutant Fails to Incorporate gH/gL Into the Virion Envelope and is Unable to Enter Fibroblasts and Epithelial and Endothelial Cells", Journal of Virology, 84(5):2585-2596 (2010).
Wille, P., et al., "Human Cytomegalovirus (HCMV) Glycoprotein gB Promotes Virus Entry in Trans Acting as the Viral Fusion Protein Rather Than as a Receptor-Binding Protein", mbio.asm.org, 4(3): e00332-13 1-9 (2013).
Woo, P., et al., "Distinct Genotypic Distributions of Cytomegalovirus (CMV) Envelope Glycoprotein in Bone Marrow and Renal Transplant Recipients with CMV Disease", Clinical & Diagnostic Laboratory Immunology, 4(5):515-518 (1997).
Wreghitt, T., et al., "Differentiation of Human Cytomegalovirus (CMV) Glycoprotein B and Glycoprotein H Types by Restriction Fragment Length Polymorphism: Association of Glycoprotein Types with CMV Disease in Heart, Heart-Lung and Lung Transplant Recipients", Journal of Heart & Lung Transplantation, 18(1):82 (1999).
Wu, S., et al., "Synthetic DNA Approach to Cytomegalovirus Vaccine/Immune Therapy", Advances in Experimental Medicine and Biology, 848:131-148 (2015).
Wussow, F., et al., "A Vaccine Based on the Rhesus Cytomegalovirus UL128 Complex Induces Broadly Neutralizing Antibodies in Rhesus Macaques", Journal of Virology, 87(3):1322-1332 (2013).
Wussow, F., et al., "Human Cytomegalovirus Vaccine Based on the Envelope gH/ gLpentamer Complex", PLOS Pathogents, 10(11):e1004524 1-23, (2014).
Yamada, S., et al., "Characterization of the Guinea Pig Cytomegalovirus Genome Locus That Encodes Homologs of Human Cytomegalovirus Major Immediate-Early Genes, UL128, and UL130", Virology, 391(1):99-106 (2009).
Yamada, S., et al., "Guinea Pig Cytomegalovirus GP129/131/133, Homologues of Human Cytomegalovirus UL128/130/131A, are Necessary for Infection of Monocytes and Macrophages", Journal of General Virology, 95 (Pt6):1376-1382 (2014).
Yamada, S., et al., "An Ex Vivo Culture Model for Placental Cytomegalovirus Infection Using Slices of Guinea Pig Placental Tissue", Placenta, 37:85-88 (2016).
Yamamoto, A., et al., Diagnosis of Congenital and Perinatal Infection by Cytomegalovirus Using Polymerase Chain Reaction]. [Portuguese] "Diagnostico de Infeccao Congenita e Perinatal Por

(56) References Cited

OTHER PUBLICATIONS

Citomegalovirus Utilizando a Reacao em Cadeia da Polimerase" Revista Da Sociedade Brasileira de Medicina Tropical, 31(1):19-26 (1998).
Yao, J., "Multimer staining of Cytomegalovirus Phosphoprotein 65-specific T Cells for Diagnosis and Therapeutic Purposes: a Comparative Study", Clinical Infectious Diseases, 46(10):E96-105 (2008).
Yurochko, A., et al., "The Human Cytomegalovirus UL55 ( gB ) and UL75 (gH) Glycoprotein Ligands Initiate the Rapid Activation of Sp1 and NF-kappaB During Infection", Journal of Virology, 719(7):5051-5059 (1997).
Yurochko, A., et al., "Human Cytomegalovirus Binding to Human Monocytes Induces Immunoregulatory Gene Expression", Journal of Immunology, 162(8):4806-4816 (1999).
Zheng, Q., et al., "HCMV-Encoded UL128 Enhances TNF-alpha and IL-6 Expression and Promotes PBMC Proliferation Through the MAPK/ERK Pathway In Vitro", Viral Immunology, 25(2):98-105 (2012).
Zhou, L., et al., "Genetic Variation Within the Glycoprotein B and H Genes of Human Cytomegalovirus in Solid Organ Transplant Recipients", Transplant Infectious Disease, 9(1):73-77 (2007).
Zhou, M., et al., "Comparative Analysis of gO Isoforms Reveals that Strains of Human Cytomegalovirus Differ in the Ratio of gH/gL/ gO and gH/ gL/ UL128-131 in the Virion Envelope", Journal of Virology, 87(17):9680-9690, (2013).
Zhou, M., et al., "Human Cytomegalovirus gH/ gL/ gO Promotes the Fusion Step of Entry into All Cell Types, whereas gH/ gL/ UL128-131 Broadens Virus Tropism through a Distinct Mechanism", Journal of Virology, 89(17):8999-9009 (2015).
Zipeto, D., et al., "Human Cytomegalovirus (CMV) DNA in plasma reflects quantity of CMV DNA present in leukocytes", Journal of Clinical Microbiology, 33(10):2607-2611 (1995).
Zydek, M., et al., "HCMV Infection of Human Trophoblast Progenitor Cells of the Placenta is Neutralized by a Human Monoclonal Antibody to Glycoprotein B and not by Antibodies to the Pentamer Complex", Viruses, 6(3):1346-1364 (2014).
Burke, H.G., et al., "Crystal Structure of the Human Cytomegalovirus Glycoprotein B" PLOS, 11(10):e1005227 21 pages (2015).
Chadramouli, S., et al., "Structure of HCMV Glycoprotein B in the Postfusion Conformation Bound to a Neutralizing Human Antiobody", Nature Communications, pp. 1-12 (2015).
Database Geneseq [Online] Jun. 7, 2012, "Cytomegalovirus glycoprotein B (gB)-SLP12-Delta725 Polypeptiede SEQ 10", database accession No. GSP:AZV29616; XP002769687.
Database Uniprot [Online] Jun. 15, 2010, "Envelope glycoprotein B, Macanine betaherpesvirus 3, Rhesus cytomegalovirus", database accession No. D5KB35; XP002769689.
Database Uniprot [Online] Mar. 19, 2014, "Envelope Glycoprotein B, Human Cytomegalovirus", database accession No. V9LN55; XP002769688.
Pass, R.F., et al., "A Subunit Cyomegalovirus Vaccine Based on Recombinant Envelope Glycoprotein B and a New Adjuvant" The Journal of Infectious Diseases 180:970-975 (1999).
Saccoccio, F., et al., "Peptides From Cytomegalovirus UL130 and UL131 Proteins Induce High Titer Antibodies That Block Viral Entry Into Mucosal Epithelial Cells", Vaccine, 29(15):2705-2711 (2011).
Sharma, et al, "HCMV gB Shares Structural and Functional Properties With gB Proteins From Other Herpesviruses", Virologyy 435(2):239-249 (2013).
Smith, et al, "Respiratory Syncytial Virus Fusion Glycoprotein Expressede in Insect Cells Form Protein Nanoparticles That Induce Protective Immunity in Cotton Rats", PLOS One 7(11): e50852.
Achour, A., et al., "Variability of gB and gH Genes of Human Herpesvirus-6 Among Clinical Specimens", Journal of Medical Virology, 80:1211-1221 (2008).
Adler, B., et al., "Role of Human Cytomegalovirus UL131A in Cell Type-Specific Virus Entry and Release", Journal of General Virology, 87:2451-2460 (2006).
Adler, B., et al., Endothelial Cells in Human Cytomegalovirus Infection: One Host Cell Out of Many or a Crucial Target for Virus Spread?, Thrombosis & Haemostasis, 102(6): 1057-1063 (2009).
Adler, S., "Immunization to Prevent Congenital Cytomegalovirus Infection", British Medical Bulletin, 107:57-68 (2013).
Akter, et al., "Two Novel Spliced Genes in Human Cytomegalovirus", Journal of General Virology 84: 1117-1122 (2003).
Al-Ahadal, et al., "Typing of Human Cytomegalovirus Clinical Isolates from Saudi Patients by PCR-RFLP", Infection, 33(2):73-76 (2005).
Albon, et al., "Optimization of Methodology for Production of CD25/CD71 Allodepleted Donor T Cells for Clinical Use", Cytotherapy 15: 109-121 (2013).
Almehmadi, M., et al., "Increased Number and Functional Activity of CD56+ T Cells in Healthy Cytomegalovirus Positive Subjects", Immunology, 142(2):258-268 (2014).
Angelini, D., et al., "Increased CD8+ T Cell Response to Epstein-Barr Virus Lytic Antigens in the Active Phase of Multiple Sclerosis", PLOS Pathogens, 9(4):1-16.
Aquino, V., et al., "Cytomegalovirus Infection in Renal Transplant Recipients Diagnosed by Nested-PCR", Brazilian Journal of Medical and Biological Research, 34(1):93-101 (2001).
Arav-Boger, "Strain Variation and Disease Severity in Congenital Cytomegalovirus Infection: In Search of a Viral Marker", Infectious Disease Clinics of North America, 29(3):401-414 (2015).
Assaf, B., et al., "Limited Dissemination and Shedding of the UL128 Complex-Intact, UL/b'-Defective Rhesus Cytomegalovirus Strain 180.92", Journal of Virology, 88(16):9310-9320 (2014).
Auerback, et al., "Characterization of the Guinea Pig CMV gH/gL/GP129/GP131/GP133 Complex in Infection and Spread", Virology, 441(1):75-84 (2013).
Baldanti, S., et al., "Human Cytomegalovirus UL131A, UL130 and UL128 Genes Are Highly Conserved Among Field Isolates", Archives of Virology, 151(6): 1225-1233 (2006).
Baldwin, J., et al., "A Role of 3-O-Sulfated Heparan Sulfate in Promoting Human Cytomegalovirus Infection in Human Iris Cells", Journal of Virology, 89(9):5185-5192 (2015).
Barry, P., "Exploiting Viral Natural History for Vaccine Development", Medical Microbiology Immunology, 204(3):255-262 (2015).
Beloki, L., et al. "The Abrogation of TCR-Independent Interactions With Human Serum Ensures a Selective Capture of Therapeutic Virus-Specific CD8+ T-Cells by Multimer Technology in Adoptive Immunotherapy", Journal of Immunological Methods, 396(1-2):168-172 (2013).
Beloki, L., et al. "Manufacturing of CMV-Specific T Cells From G-CSF Mobilised Donors for Adoptive Immunotherapy That Preserve Strong Anti-Viral and Cytotoxic Activity", 16(4):S20 (2014).
Beloki, L., et al. "CMV-Specific T Cell Isolation From G-CSF Mobilized Peripheral Blood: Depletion of Myeloid Progenitors Eliminates Non-Specific Binding of MHC-Multimers, Journal of Translational Medicine", 12:317 (2014).
Beninga, Comparative Analysis of Fourteen Individual Human Cytomegalovirus Proteins for Helper T Cell Response, Journal of General Virology 76:153-160 (1995).
Berger, I., et al., "Baculovirus Expression System for Heterologous Multiprotein Complexes", Nat Biotechnol, 22(12):1583-7 (2004).
Bevan, I., et al., "Investigation of Murine Cytomegalovirus Latency and Reactivation in Mice Using Viral Mutants and the Polymerase Chain Reaction", Journal of Medical Virology, 48(4):308-320 (1996).
Binder, T., et al., "Identification of Human Cytomegalovirus Variants by Analysis of Single Strand Conformation Polymorphism and DNA Sequencing of the Envelope Glycoprotein B Gene Region-Distribution Frequency in Liver Transplant Recipients", Journal of Virological Methods 78:153-162 (1999).
Biotechnet: "The Vaccine-Factory in the Box—from vision to reality", Swissinnovate, Retrieved from the Internet, http://webcache.goofleusercontent.com/search?q=cache:PtrCZH9byBkJ:www.biotechnet.com, 1, 19, 20 (2013).
Boccuni, M., et al., "Human Cytomegalovirus Product UL44 Downregulates the Transactivation of HIV-1 Long Terminal Repeat", AIDS 12(4):365-372 (1998).
Boechk, M., et al., "Randomized, Placebo-Controlled, Double-Blind Study of a Cytomegalovirus-Specific Monoclonal Antibody

(56) References Cited

OTHER PUBLICATIONS (MSL-109) for Prevention of Cytomegalovirus Infection After Allogeneic Hematopoietic Stem Cell Transplantation", Biology of Blood & Marrow Transplantation, 7(6):343-351 (2001).

Boehme, KW., et al., Human Cytomegalovirus Envelope Glycoproteins B and H are Necessary for TLR2 Activation in Permissive Cells, Journal of Immunology, 177:(10)7094-7102 (2006).

Boppana, S. et al., "Transplacentally Acquired Antiviral Antibodies and Outcome in Congenital Human Cytomegalovirus Infection", Viral Immunology, 9(4)211-218 (1996).

Boppana, S. et al., "Recognition of Human Cytomegalovirus Gene Products by HCMV-Specific Cytotoxic T Cells", Virology, 222(1):293-296 (1996).

Borchers, S., "Multimer monitoring of CMV-Specific T Cells in Research and in Clinical Applications", Diagnostic Microbiolgoy & Infectious Disease, 78(3):201-212 (2014).

Bowman, J., et al., "Rhesus and Human Cytomegalovirus Glycoprotein L Are Required for Infection and Cell-To-Cell Spread of Virus But Cannot Complement Each Other", Journal of Virology, 85(5):2089-2099 (2011).

Brady, R., et al., "Identification and Characterization of the Guinea-Pig Cytomegalovirus Glycoprotein H Gene", Archives of Virology, 141(12):2409-2424 (1996).

Britt, W., et al., "Human Cytomegalovirus Glycoproteins", Intervirology, 39(5-6):401-412 (1996).

Britt, W., et al., "Human Cytomegalovirus Virion Proteins", Human Immunology, 65(5):395-402 (2004).

Bueno, J., et al., "Current Management Strategies for the Prevention and Treatment of Cytomegalovirus Infection in Pediatric Transplant Recipients", Pediatic Drugs, 4(5): 279-290 (2002).

Buscher, N., et al., "The Proteome of Human Cytomegalovirus Virions and Dense Bodies Is Conserved Across Differenct Strains", Medical Microbiology & Immunology, 204(3):285-293 (2015).

Butcher, S., et al., "Structure of the Human Cytomegalovirus B Capsid by Electron Cryomicroscopy and Image Reconstruction", Journal of Structural Biology, 124:70-76 (1998).

Cerutti, M., et al., "Lepidopteran cells, an alternative for the production of recombinant antibodies?", MAbs. May-Jun. 2012;4(3):294-309. Epub Apr. 26, 2012.

Chan, Y., et al., "Two Distinct Upstream Regulatory Domains Containing Multicopy Cellular Transcription Factor Binding Sites Provide Basal Repression and Inducible Enhancer Characteristics to the Immediate-Early IES (US3) Promoter From Human Cytomegalovirus", Journal of Virology, 70(8):5312-5328 (1996).

Chiuppesi, F., et al., "Vaccine-Derived Neutralizing Antibodies to the Human Cytomegalovirus gH/ gLPentamer Potently Block Primary Cytotrophoblast Infection", Journal of Virology, 89(23):11884-1198 (2015).

Chou, S., "Molecular Epidemiology of Envelope Glycoprotein H of Human Cytomegalovirus", Journal of Infectious Diseases, 166(3):604-607 (1992).

Ciferri, et al., "Antigenic Characterization of the HCMV gH/ gL/ gO and Pentamer Cell Entry Complexes Reveals Binding Sites for Potently Neutralizing Human Antibodies", PLOS Pathogens, 11(10):1-20 (2015).

Ciferri, et al.,"Structural and Biochemical Studies of HCMV gH/ gL/ gO and Pentamer Reveal Mutually Exclusive Cell Entry Complexes", PNAS, 112:(6):1767-1772 (2015).

Coleman, et al., "Viral Glycoprotein Complex Formation, Essential Function and Immunogenicity in the Guinea Pig Model for Cytomegalovirus", PLOS One, 10(8):1-33 (2015).

Compton, et al., "An Immortalized Human Fibroblast Cell Line is Permissive for Human Cytomegalovirus Infection", Journal of Virology, 67:(6):3644-3648 (1993).

Corti, D., et al., "Efficient Methods to Isolate Human Monoclonal Antibodies from Memory B Cells and Plasma Cells", Microbiology Spectrum, 2(5):1-9 (2014).

Cox, MM, Hashimoto Y. A fast track influenza virus vaccine produced in insect cells. J Invertebr Pathol. Jul. 2011;107 Suppl:S31-41.

Cruz Cosme, R., et al., "Functional Interaction of Nuclear Domain 10 and Its Components with Cytomegalovirus after Infections: Cross-Species Host Cells versus Native Cells", PLOS One, 6(4):e19187 (2011).

Daniel, V., et al., "HIV-Specific CD8(+) T Lymphocytes in Blood of Long-Term HIV-Infected Hemophilia Patients", BioResearch Open Access, 2(6):399-411 (2013).

Decrion, A., et al., "A Subset of Functional Effector-Memory CD8+ T Lymphocytes in Human Immunodeficiency Virus-Infected Patients", Immunology, 121(3)405-415 (2007).

DeVries, et al., Rapid Genotyping of Cytomegalovirus in Dried Blood Spots by Multiplex Real-Time PCR Assays Targeting the Envelope Glycoprotein gB and gH Genes, Journal of Clinical Microbiology, 50(2)232-237 (2012).

DeVries, et al., "Cytomegalovirus DNA Detection in Dried Blood Spots and Perilymphatic Fluids From Pediatric and Adult Cochlear Implant Recipients With Prelingual Deafness", Journal of Clinical Virology, 56(2):113-117 (2013).

Digel, et al., Determinants of Endothelial Cell Tropism of Human Cytomegalovirus, Molecular Biolgy and Immunolgy, 445-464 (2006).

Dolan, et al., "Genetic Content of Wild-Type Human Cytomegalovirus", Journal of General Virology, 85:1301-1312 (2004).

Douvas, A., et al., "Multiple Overlapping Homologies Between Two Rheumatoid Antigens and Immunosuppressive Viruses", Proc. Natl. Acad. Sci., 88(14):6328-6332 (1991).

Eggers, M., et al., "Use of Recombinant Glycoprotein Antigens gB and gH for Diagnosis of Primary Human Cytomegalovirus Infection During Pregnancy", Journal of Medical Virology, 63(2):135-142 (2001).

Eisenberg, R., et al., "Herpes Virus Fusion and Entry: A Story with Many Characters", Viruses 4(5):800-832 (2012).

Elkington, R., et al., "Cross-Reactive Recognition of Human and Primate Cytomegalovirus Sequences by Human CD4 Cytotoxic T Lymphocytes Specific for Glycoprotein B and H", Eur. J. Immunol, 34(11):3216-3226 (2004).

Engel, P., et al., "Viral Immunomodulatory Proteins: Usurping Host Genes as a Survival Strategy", Self and Nonself Advances in Experimental Medicine and Biology, 738:256-276 (2012).

English, et al., "Foldamer-Based Inhibitors of Cytomegalovirus Entry", Antiviral Research, 70(1):A32 (2006).

English, et al., "Rational Development of Beta-Peptide Inhibitors of Human Cytomegalovirus Entry", 281(5):2661-2667 (2006).

Fornara, O., et al., "Human Cytomegalovirus Particles Directly Suppress CD4 T-Lymphocyte Activation and Proliferation", Immunobiology, 218(8):1034-1040 (2013).

Fouts, A. et al., "Antibodies Against the gH/ gL/ UL128/UL130/ UL131 Complex Comprise the Majority of the Anti-Cytomegalovirus (anti-CMV) Neutralizing Antibody Response in CMV Hyperimmune Globulin", Journal of Virology, 86(13):7444-7447 (2012).

Fouts, A., et al., "Mechanism for neutralizing activity by the anti-CMV gH/ gLmonoclonal antibody MSL-109", PNAS, 111(22):8209-8214 (2014).

Freed, D.C., et al., "Pentameric complex of viral glycoprotein H is the primary target for potent neutralization by a human cytomegalovirus vaccine", Proceedings of the National Academy of Scienes, 110(51):E4997-E5005 (2013).

Fu, T.M., et al., "Progress on pursuit of human cytomegalovirus vaccines for prevention of congenital infection and disease", Vaccine, 32(22):2525-2533 (2014).

Fu, T.M., et al., "Restoration of Viral Epithelial Tropism improves immunogenicity in rabbits and rhesus macaques for a whole virion vaccine of human Cytomegalovirus", Vaccine, 30(52):7469-7474 (2012).

Fukushima, E., et al., "Identification of a Highly Conserved Region in the Human Cytomegalovirus Glycoprotein H Gene and Design of Molecular Diagnostic Methods Targeting the Region", Journal of Virological Methods, 151(1):55-60 (2008).

Ge, X., et al., "CD134-Allodepletion Allows Selective Elimination of Alloreactive Human T Cells Without Loss of Virus-Specific and Leukemia-Specific Effectors", Biology of Blood & Marrow Transplatation 14(5):518-530 (2008).

Genini, E., et al., Serum Antibody Response to the gH/ gL/ pUL128-131 Five-Protein Complex of Human Cytomegalovirus

(56) References Cited

OTHER PUBLICATIONS (HCMV) in Primary and Reactivated HCMV Infections, Journal of Clinical Virology, 52(2):113-118 (2011).
Gerna, G., et al., Dendritic-Cell Infection by Human Cytomegalovirus is Restricted to Strains Carrying Functional UL131-128 Genes and Mediates Efficient Viral Antigen Presentation to CD8+ T Cells, Journal of General Virology, 86:275-284 (2005).
Gerna, G., et al., Human Cytomegalovirus Serum Neutralizing Antibodies Block Virus Infection of Endothelial/Epithelial Cells, but Not Fibroblasts, Early During Primary Infection, Journal of General Virology, 89:853-865 (2008).
Gerna, G., et al., "Differential Kinetics of Human Cytomegalovirus Load and Antibody Responses in Primary Infection of the Immunocompetent and Immunocompromised Host", Journal of General Virology, 96:360-369 (2015).
Gill, T., et al.,"Replication-Defective Mutants of Mouse Cytomegalovirus Protect Against Wild-Type Virus Challenge", Journal of Medical Virology, 62(2):127-139 (2000).
Gnanandarajah, J., et al., Identification by Mass Spectrometry and Immune Response Analysis of Guinea Pig Cytomegalovirus (GPCMV) Pentameric Complex Proteins GP129, 131 and 133, Viruses, 6(2):727-751 (2014).
Gonczol, E., et al., "Development of a Cytomegalovirus Vaccine: Lessons From Recent Clinical Trials", Expert Opinion on Biological Therapy, 1(3):401-412 (2001).
Gorzer, I., et al., "Virus Load Dynamics of Individual CMV-Genotypes in Lung Transplant Recipients with Mixed-Genotype Infections", Journal of Medical Virology, 80(8):1405-1414 (2008).
Gorzer, I., et al., "Analysis of Human Cytomegalovirus Strain Populations in Urine Samples of Newborns by Ultra Deep Sequencing", Journal of Clinical Virology, 73:101-104 (2015).
Gredmark, S., et al., "Human Cytomegalovirus Induces Inhibition of Macrophage Differentiation by Binding to Human Aminopeptidase N/CD13", Journal of Immunology, 173(8):4897-48907 (2004).
Griesenbach, U., et al., "Gene Therapy Progress and Prospects: Cystic Fibrosis", Gene Therapy, 13(14):1061-1067 (2006).
Grosjean, J., et al., "Human Cytomegalovirus Quantification in Toddlers Saliva From Day Care Centers and Emergency Unit: A Feasibility Study", 61(3):371-377 (2014).
Hahn, G., et al., "Human Cytomegalovirus UL131-128 Genes Are Indispensable for Virus Growth in Endothelial Cells and Virus Transfer to Leukocytes", Journal of Virology, 78(18):10023-10033 (2004).
Halwachs-Baumann, G., et al., "Virus-Host Interaction for Defence and Transmission", Biosis Previews Congenital Cytomegalovirus Infection: Epidemiology, Diagnosis, Therapy, 11-51 (2011).
Hansen, S., et al., "Cytomegalovirus Vectors Violate CD8+ T Cell Epitope Recognition Paradigms", Science, 340:1237874-1-1237874-17 (2013).
Hobom, U., et al., "Fast Screening Procedures for Random Transposon Libraries of Cloned Herpesvirus Genomes: Mutational Analysis of Human Cytomegalovirus Envelope Glycoprotein Genes", Journal of Virology, 74(17):7720-7729 (2000).
Hofmann, I., et al., "Expression of the Human Cytomegalovirus Pentamer Complex for Vaccine Use in a CHO System", Biotechnology & Bioengineering, 112(12):2505-2515 (2015).
Hui-Hui, G., et al., "Recombinant HCMV UL128 Expression and Functional Identification of PBMC-Attracting Activity In Vitro", Archives of Virology, 158(1):173-177 (2013).
Ibig-Rehm, Y., et al., "High-Content Screening to Distinguish Between Attachment and Post-Attachment Steps of Human Cytomegalovirus Entry Into Fibroblasts and Epithelial Cells", Aniviral Research, 89(3):246-256 (2011).
Ikuta, K., et al., "Cytomegalovirus (CMV) Glycoprotein H-Based Serological Analysis in Japanese Healthy Pregnant Women, and in Neonates With Congenital CMV Infection and Their Mothers", Journal of Clinical Virology, 58(2):474-478 (2013).
Ishibashi, K., et al., "Strain-Specific Seroepidemiology and Reinfection of Cytomegalovirus", Microbes & Infection 10(12-13):1363-1369 (2008).
Ishibashi, K., et al., "Lack of Antibodies Against the Antigen Domain 2 Epitope of Cytomegalovirus (CMV) Glycoprotein B is Associated With CMV Disease After Renal Transplantation in Recipients Having the Same Glycoprotein H Serotypes as Their Donors", Transplant Infectious Disease, 13(3):318-323 (2011).
Jacob, C., et al., "Neutralizing Antibodies Are Unable to Inhibit Direct Viral Cell-To-Cell Spread of Human Cytomegalovirus", Virology 444(1-2):140-147 (2013).
Jarvis, M., et al., "Human Cytomegalovirus Infection of Caco-2 Cells Occurs at the Basolateral Membrane and is Differentiation State Dependent", Journal of Virology 73(6):4552-4560 (1999).
Jaskula, E., et al., "Severe CMV Load Post HSCT is Inversely Correlated With a Proportion of CD8high+Pro5 Pentamer HLA-A*0201/NLVPMVATV (CMV pp65)+ Cells and Associates With a Risk of Fatal Complications", Biosis Previews Bone Marrow Transplantation, 39(1):S163 (2007).
Jiang, X., et al., "UL74 of Human Cytomegalovirus Reduces the Inhibitory Effect of gH-Specific and gB-Specific Antibodies", Archives of Virology, 156(2):2145-255 (2011).
Kabanova, A., et al., "Antibody-Driven Design of a Human Cytomegalovirus gHgLpUL128L Subunit Vaccine That Selectively Elicits Potent Neutralizing Antibodies", PNAS, 111(50):17965-17970 (2014).
Karlsson, H., et al., Generation of Trispecific Cytotoxic T Cells Recognizing Cytomegalovirus, Adenovirus, and Epstein-Barr Virus: An Approach for Adoptive Immunotherapy of Multiple Pathogens, Journal of Immunotherapy, 30(5):544-556 (2007).
Kinzler, et al., "Characterization of Human Cytomegalovirus Glycoprotein-Induced Cell-Cell Fusion", Journal of Virology, 79(12):7827-7837 (2005).
Klein, M., et al., "Strain-Specific Neutralization of Human Cytomegalovirus Isolates by Human Sera", Journal Virology, 73(2):878-886 (1999).
Klinger, M., et al., "Combining Next-Generation Sequencing and Immune Assays: A Novel Method for Identification of Antigen-Specific T Cells", PLOS One, 8(9):e74231 1-9 (2013).
Klupp, B., et al., "Pseudorabies Virus Glycoprotein M Inhibits Membrane Fusion", Journal of Virology, 74(15):6760-6768 (2000).
Kropff, B., et al., "Glycoprotein N of Human Cytomegalovirus Protects the Virus From Neutralizing Antibodies", PLOS Pathogens 8(10):e1002999 1-15 (2012).
Kuntz, M., et al., Analysis of Bulk and Virus-Specific CD8+ T Cells Reveals Advanced Differentiation of CD8+ T Cells in Patients With Common Variable Immunodeficiency, Clinical Immunology, 141(2):177-186 (2011).
Landais, I., et al., "Human Cytomegalovirus miR-UL112-3p Targets TLR2 and Modulates the TLR2/IRAK1/NFkappaB Signaling Pathway", PLOS Pathogens, 11(5):e1004881, 1-21 (2015).
Lauron, E., et al., "Human Cytomegalovirus Infection of Langerhans-Type Dendritic Cells Does Not Require the Presence of the gH/ gL/ UL128-131A Complex and is Blocked After Nuclear Deposition of Viral Genomes in Immature Cells", Journal of Virology, 88(1):403-416 (2014).
Lee, S., et al., "Monitoring of Cytomegalovirus-Specific CD8+ T-Cell Response with Major Histocompatibility Complex Pentamers in Kidney Transplant Recipients", Transplantation Proceedings, 43(7):2636-2640 (2011).
Li, L., et al., "Glycoprotein H-Related Complexes of Human Cytomegalovirus: Identification of a Third Protein in the gCIII Complex", Journal of Virology, 71(4):3090-3097 (1997).
Li, G., et al., "A Viral Regulator of Glycoprotein Complexes Contributes to Human Cytomegalovirus Cell Tropism", PNAS, 112(14):4471-4476 (2015).
Li, Q., et al., "THY-1 Cell Surface Antigen (CD90) Has an Important Role in the Initial Stage of Human Cytomegalovirus Infection", PLOS Pathogens, 11(7):E1004999, 1-26 (2015).
Lilja, A., et al., "Efficient Replication of Rhesus Cytomegalovirus Variants in Multiple Rhesus and Human Cell Types", PNAS, 105(50): 19950-19955 (2008).
Lilleri, D., et al., "Antibodies Against Neutralization Epitopes of Human Cytomegalovirus gH/ gL/ pUL128-130-131 Complex and Virus Spreading May Correlate with Virus Control in Vivo", Journal of Clinical Immunology, 32(6):1324-1331 (2012).

(56) References Cited

OTHER PUBLICATIONS

Lilleri, D., et al., "Fetal Human Cytomegalovirus Transmission Correlates with Delayed Maternal Antibodies to gH/ gL/ pUL128-130-131 Complex During Primary Infection", PLOS One, 8(3):e59863, 1-13 (2013).
Liu, A., et al., "Evaluation of Human Cytomegalovirus-Specific CD8+ T-Cells in Allogeneic Haematopoietic Stem Cell Transplant Recipients Using Pentamer and Interferon-Gamma-Enzyme-Linked Immunospot Assays", Journal of Clinical Virology, 58(2):427-431 (2013).
Liu, A., et al., "Preliminary Exploration of HLA-A 1101-Restricted human Cytomegalovirus Glycoprotein B-Specific CD8+ T Cells in Allogeneic Stem-Cell Transplant Recipients", Virus Research, 188:38-44 (2014).
Liu, et al., "Protective MCMV Immunity by Vaccination of the Salivary Gland via Wharton's Duct: Replication Deficient Recombinant Adenovirus Expressing Individual MCMV Genes Elicits Protection Similar to that of MCMV", FASEB Journal, 28(4):1698-710 (2014).
Lipira, G., et al., "A Sealed and Unbreached System for Purification, Stimulation, and Expansion of Cytomegalovirus-Specific Human CD4 and CD8 T Lymphocytes", Transfusion 46(12):2053-2062 (2006).
Loomis, R., et al., "Vectored Co-Delivery of Human Cytomegalovirus gH and gL Proteins Elicits Potent Complement-Independent Neutralizing Antibodies", Vaccine, 31(6):919-926 (2013).
Lopper, M., et al., "Coiled-Coil Domains in Glycoproteins B and H are Involved in Human Cytomegalovirus Membrane Fusion", Journal of Virology, 78(15):8333-8341 (2004).
Loughney, J., et al., "Soluble Human Cytomegalovirus gH/ gL/ pUL128-131 Pentameric Complex, but Not gH/ gL, Inhibits Viral Entry to Epithelial Cells and Presents Dominant Native Neutralizing Epitopes", Journal of Biological Chemistry, 290(26):15985-15995 (2015).
Ma, Y., et al., "Novel Transcripts of Human Cytomegalovirus Clinical Strain Found by cDNA Library Screening", Genetics & Molecular Research, 10(2):566-575 (2011).
Macagno, A., et al., "Isolation of Human Monoclonal Antibodies That Potently Neutralize Human Cytomegalovirus Infection by Targeting Different Epitopes on the gH/gL/UL128-131A Complex", Journal of Virology, 84(2):1005-1013 (2010).
Madi, N., et al., "Cytomegalovirus genotypes gB 1 and gH1 are the most predominant genotypes among renal transplant recipients in Kuwait", Transplantation Proceedings, 43(5):1634-1637 (2011).
Manley, K., et al., "Human Cytomegalovirus Escapes a Naturally Occurring NeutralizingAntibody by Incorporating It into Assembling Virions", Cell Host & Microbe, 10(3):197-209 (2011).
Mattick, C., et al., Linkage of Human Cytomegalovirus Glycoprotein gO Variant Groups Identified from Worldwide Clinical Isolates with gN Genotypes, Implications for Disease Associations and Evidence for N-Terminal Sites of Positive Selection, Virology, 318(2):582-597 (2004).
Mccormick, L., et al., "The Immunological Underpinnings of Vaccinations to Prevent Cytomegalovirus Disease", Cellular and Molecular Immunology, 12(2):170-179 (2015).
Mcsharry, B., et al., "Human Cytomegalovirus Encoded Homologs of Cytokines, Chemokines and their Receptors: Roles in Immunomodulation", Viruses-Basel 4(11):2448-2470 (2012).
Mcvoy, M. et al., "Cytomegalovirus Vaccines", Clinical Infectious Diseases, 57(4):S196-199 (2013).
Mcvoy, M. et al., "A Cytomegalovirus DNA Vaccine Induces Antibodies that Block Viral Entry into Fibroblasts and Epithelial Cells", Vaccine, 33(51):7328-7336 (2015).
Meyer, H., et al., "Glycoprotein gp116 of Human Cytomegalovirus Contains Epitopes for Strain-Common and Strain-Specific Antibodies", Journal of General Virology, 73:2375-2383 (1992).
Mochizuki, T., et al., "Cucumber Mosaic Virus: Viral Genes as Virulence Determinants", Molecular Plant Pathology, 13(3):217-225 (2012).
Muller, "Pattern and Persistence of the Epitope-Specific IgM Response Against Human Cytomegalovirus in Renal Transplant Patients", Journal of Clinical Virology, 24(1-2):45-56 (2002).
Murhammer, D., "Ed Baculovirus and Inspect Cell Expression Protocols" 2nd Ed. Methods Mol Biol. 388 (2007).
Murrell, I., et al., Impact of Sequence Variation in the UL128 Locus on Production of Human Cytomegalovirus in Fibroblast and Epithelial Cells, Journal of Virology, 87(19):10489-10500 (2013).
Nejatollahi, F., et al., "Neutralising Human Recombinant Antibodies to Human Cytomegalovirus Glycoproteins gB and gH", FEMS Immunology & Medical Microbiology, 34(3):237:244 (2002).
Nellore A., et al., The Cyclin Dependent Kinase Inhibitor (R)-Roscovitine Mediates Selective Suppression of Alloreactive Human T cells but Preserves Pathogen-Specific and Leukemia-Specific Effectors, Clinical Immunology, 152(1-2):48-57 (2014).
Nie, Y., et al., "Multiprotein Complex Production in Insect Cells by Using Polyproteins", Methods Mol Biol., 1091:131-141 (2014).
Nogalski, M., et al., "The Human Cytomegalovirus Virion Possesses an Activated Casein Kinase II That Allows for the Rapid Phosphorylation of the Inhibitor of NF-kappaB, IkappaBalpha", Journal of Virology, 81(10):5305-5314 (2007).
Nogalski, M., et al., "The HCMV gH/gL/UL128-131 Complex Triggers the Specific Cellular Activation Required for Efficient Viral Internalization Into Target Monocytes", PLOS Pathogens, 9(7):e1003463 1-20 (2013).
Ohlin, M., et al., "Human Antibody Technology and the Development of Antibodies Against Cytomegalovirus", Molecular Immunology, 67:153-170 (2015).
Okada, T., et al., "N-Glycosylation engineering of lepidopteran insect cells by the introduction of the beta1,4-N-acetylglucosaminyltransferase III gene" Glycobiology. Sep. 2010;20(9):1147-59.Epub Jun. 16, 2010.
Omoto, S., et al., Transcription of True Late (gamma2) Cytomegalovirus Genes RequiresUL92 Function That Is Conserved among Beta-andGammaherpesviruses, Journal of Virology, 88(1):120-130 (2014).
O'Reilly DR, et al., "Baculovirus Expression Vectors: A laboratory Manual" Oxford: Oxford University Press, See Chapter 2, "Gene Organization, Regulation, and Function."
Pachnio, A., et al., "The Cellular Localization of Human Cytomegalovirus Glycoprotein Expression Greatly Influences the Frequency and Functional Phenotype of Specific CD4+ T Cell Responses", Journal of Immunology, 195(8):3803-3815, (2015).
Pati, S., et al., "Strain-Specific Neutralizing Antibody Responses Against Human Cytomegalovirus Envelope Glycoprotein N", Clinical & Vaccine Immunology, 19(6):909-913 (2012).
Pati, S., et al., Genotypic Diversity and Mixed Infection in Newborn Disease and Hearing Loss in Congenital Cytomegalovirus Infection, Pediatric Infectious Disease Journal, 32(10):1050-1054 (2013).
Patrone, M., et al., Cytomegalovirus UL131-128 Products Promote gB Conformational Transition and gB-gH Interaction During Entry Into Endothelial Cells, Journal of Virology, 81(20):11479-11488 (2007).
Patrone, M., et al., "Palmitoylation Strengthens Cholesterol-Dependent Multimerization and Fusion Activity of Human Cytomegalovirus Glycoprotein B (gB)", Journal of Bilogical Chemistry, 291(9):4711-4722 (2016).
Peppenelli, M., et al., "Human Cytomegalovirus Stimulates the Synthesis of Select Akt-Dependent Antiapoptotic Proteins during Viral Entry to Promote Survival of Infected Monocytes", Journal of Virology, 90(6):3138-3147 (2016).
Pepperl S., et al., "Dense Bodies of Human Cytomegalovirus Induce Both Humoral and Cellular Immune Responses in the Absence of Viral Gene Expression", Journal of Virology, 74(13):6132-6146 (2000).
Pharmigen,"Baculovirus Expression Vector System Manual", Instruction Manual, 6th Ed. May 1999.
Afonine et al, "Real-space refinement in PHENIX for cryo-EM and crystallography", Acta Crystallography D—Structural Biology D74:531-544 (2018).
Allen et al, "Cambridge Crystallographic Data Centre. II. Structural Data File", Journal of Chemical Documentation 13(3):119-123 (1973).

(56) References Cited

OTHER PUBLICATIONS

Appelt, "Crystal structures of HIV-1 protease-inhibitor complexes", Perspectives in Drug Discovery and Design 1:23-48 (1993).
Bartlett et al, "CAVEAT: A Program to Facilitate the Structure-derived Design of Biologically Active Molecules", Special Publication—Royal Society of Chemistry 78:182-196 (1989).
Bloom et al, "Thiourea inhibitors of herpes viruses. Part 2: N-Benzyl-N'-arylthiourea inhibitors of CMV", Bioorganic & Medicinal Chemistry Letters 14:3401-3406 (2004).
Boobbyer et al., "New Hydrogen-Bond Potentials for Use in Determining Energetically Favorable Binding Sites on Molecules of Known Structure", Journal of Medicinal Chemistry 32:1083-1094 (1989).
Britt & Willett, "Pharmacophoric pattern matching in files of 3D chemical structures: comparison of geometric searching algorithms", Journal of Molecular Graphics 5(1):49-56 (1987).
Bugg et al, "Drugs by Design", Scientific American 269(6):92-98 (1993).
Cohen et al., "Molecular Modeling Software and Methods for Medicinal Chemistry", Journal of Medicinal Chemistry 33(3):883-894 (1990).
Crawford et al, "Humanized mouse models of human cytomegalovirus infection", Current Opinion in Virology 13:86-92 (2015).
Cwirla et al, "Peptides on phage: A vast library of peptides for identifying ligands", Proc. Natl. Acad. Sci. 87:6378-6382 (1990).
Czarnik, "Encoding methods for combinatorial chemistry", Current Opinion in Chemical Biology 1(1):60-66 (1997).
Desjarlais et al, "Docking Flexible Ligands to Macromolecular Receptors by Molecular Shape", Journal of Medicinal Chemistry 29(11):2149-2153 (1986).
Desjarlais et al, "Using Shape Complementarity as an Initial Screen in Designing Ligands for a Receptor Binding Site of Known Three-Dimensional Structure", Journal of Medicinal Chemistry 31(4):722-729 (1988).
Devlin et al, "Random Peptide Libraries: A Source of Specific Protein Binding Molecules", Science 249(4967):404-406 (1990).
Dunbrack et al, "Meeting review: the Second Meeting on the Critical Assessment of Techniques for Protein Structure Prediction (CASP2), Asilomar, California, Dec. 13-16, 1996", Folding & Design 2:27-42 (1997).
Ellison and Hochstrasser, "Epitope-tagged Ubiquitin: A New Probe for Analyzing Ubiquitin Function", The Journal of Biological Chemistry 266(31):21150-21157 (1991).
Emsley et al, "Features and development of Coot", Acta Crystallographica Section D—Biological Crystallography D66:486-501 (2010).
Erickson, "Design and structure of symmetry-based inhibitors of HIV-1 protease", Perspectives in Drug Discovery and Design 1:109-128 (1993).
Furka et al, "General method for rapid synthesis of multicomponent peptide mixtures", International Journal of Peptide and Protein Research 37:487-493 (1991).
Goodford, "A Computational Procedure for Determining Energetically Favorable Binding Sites on Biologically Important Macromolecules", Journal of Medicinal Chemistry 28(7):849-857 (1985).
Habig et al, "Glutathione S-Transferases: The First Enzymatic Step in Mercapturic Acid Formation", The Journal of Biological Chemistry 249(22):7130-7139 (1974).
Harrison, "Viral membrane fusion", Virology 479-480:498-507 (2015).
Jakes & Willett, "Pharmacophoric pattern matching in files of 3-D chemical structures: selection of interatomic distance screens", Journal of Molecular Graphics 4:12-20 (1986).
Jakes et al, "Pharmacophoric pattern matching in files of 3D chemical structures: evaluation of search performance", Journal of Molecular Graphics 5(1):41-48 (1987).
Kuntz et al, "A geometric approach to macromolecule-ligand interactions", Journal of Molecular Biology 161(2):269-288 (1982).

Lam et al, "Rational Design of Potent, Bioavailable, Nonpeptide Cyclic Ureas as HIV Protease Inhibitors", Science 263(5145):380-384 (1994).
Lawrence & Davis, "CLIX: A Search Algorithm for Finding Novel Ligands Capable of Binding Proteins of Known Three-Dimensional Structure", Proteins: Structure, Function and Bioinformatics 12(1):31-41 (1992).
Lee, J.K. et al., "Reversible Inhibition of the Fusion Activity of Measles Virus F Protein by an Engineered Intersubunit Disulfide Bridge", Journal of Virology 81(16):8821-8826 (2007).
Lee, P.S. et al., "Design and Structure of an Engineered Disulfide-Stabilized Influenza Virus Hemagglutinin Trimer", Journal of Virology 89(14):7417-7420 (2015).
Liu et al, "Prefusion structure of human cytomegalovirus glycoprotein B and structural basis for membrane fusion", Science Advances 7(10):eabf3178 (2021).
Ludtke et al, "EMAN: Semiautomated Software for High-Resolution Single-Particle Recontructions", Journal of Structural Biology 128(1):82-97 (1999).
Maidji et al, "Impaired Surfactant Production by Alveolar Epithelial Cells in a SCID-hu Lung Mouse Model of Congenital Human Cytomegalovirus Infection", Journal of Virology 86(23):12795-12805 (2012).
Mclellan, J.S. et al., "Structure-Based Design of a Fusion Glycoprotein Vaccine for Respiratory Syncytial Virus", Science 342(6158):592-598 (2013).
Pötzsch et al, "B Cell Repertoire Analysis Identifies New Antigenic Domains on Glycoprotein B of Human Cytomegalovirus which Are Target of Neutralizing Antibodies", PLoS Pathogens 7(8):e1002172 (2011).
Roche et al, "Structure of the Prefusion Form of the Vesicular Stomatitis Virus Glycoprotein G", Science 315(5813):843-848 (2007).
Sanders, R.W. et al., "A Next-Generation Cleaved, Soluble HIV-1 Env Trimer, BG505 SOSIP.664 gp140, Expresses Multiple Epitopes for Broadly Neutralizing but Not Non-Neutralizing Antibodies", Plos Pathogens 9(9):e1003618 (2013).
Scheres, "RELION: Implementation of a Bayesian approach to cryo-EM structure determination", Journal of Structural Biology 180:519-530 (2012).
Schmidt et al, "Peptide Inhibitors of Dengue-Virus Entry Target a Late-Stage Fusion Intermediate", PLoS Pathogens 6(4):e1000851 (2010).
Scott & Smith, "Searching for Peptide Ligands with an Epitope Library", Science 249(4967):386-390 (1990).
Sebestyen et al., "Chemical Synthesis of Peptide Libraries", Bioorganic & Medicinal Chemistry Letters 3(3):413-418 (1993).
Si et al., "Different functional states of fusion protein gB revealed on human cytomegalovirus by cryo electron tomography with Volta phase plate", PLoS Pathogens 14(12):e1007452 (2018).
Stewart-Jones, G.B.E. et al., "A Cysteine Zipper Stabilizes a Pre-Fusion F Glycoprotein Vaccine for Respiratory Syncytial Virus", PLos One 10(6):e0128779 (2015).
Thompson and Ellman, "Synthesis and Applications of Small Molecule Libraries", Chemical Reviews 96:555-600 (1996).
Urnavicius et al, "The structure of the dynactin complex and its interaction with dynein", Science 347(6229):1441-1446 (2015).
West & Fairlie, "Targeting HIV-1 protease: a test of drug-design methodologies", Trends in Pharmacological Sciences 16(2):67-75 (1995).
White, E. et al., "The Incredible Stability of Postfusion HCMV Glycoprotein B", Award Winners and Abstracts of the 31st Annual Symposium of the Protein Society, Abstract # POS416. Montreal, Canada Jul. 24-27, 2017.
Wlodawer & Erickson, "Structure-Based Inhibitors of HIV-1 Protease", Annu. Rev. Biochem. 62:543-585 (1993).
Zhang, "Gctf: Real-time CTF determination and correction", Journal of Structural Biology, 193:1-12 (2016).
Zheng et al, "MotionCor2: anisotropic correction of beam-induced motion for improved cryo-electron microscopy", Nature Methods 14(4):331-332 (2017).

* cited by examiner

FIG. 1
A
2D projections from a postfusion gB structure
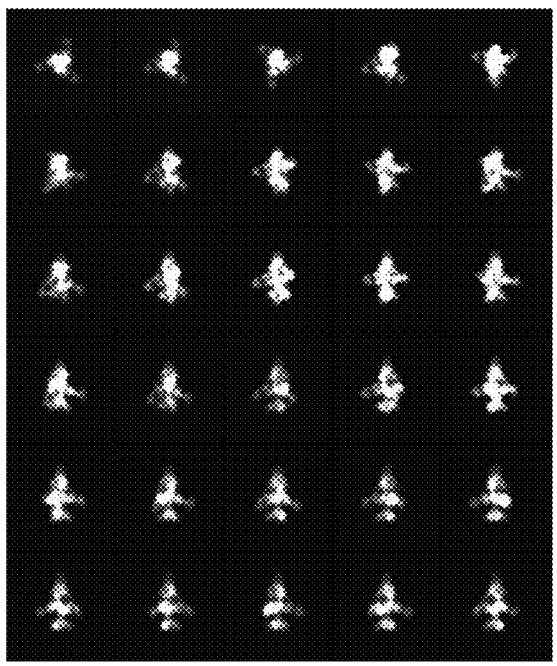
B
2D class averages
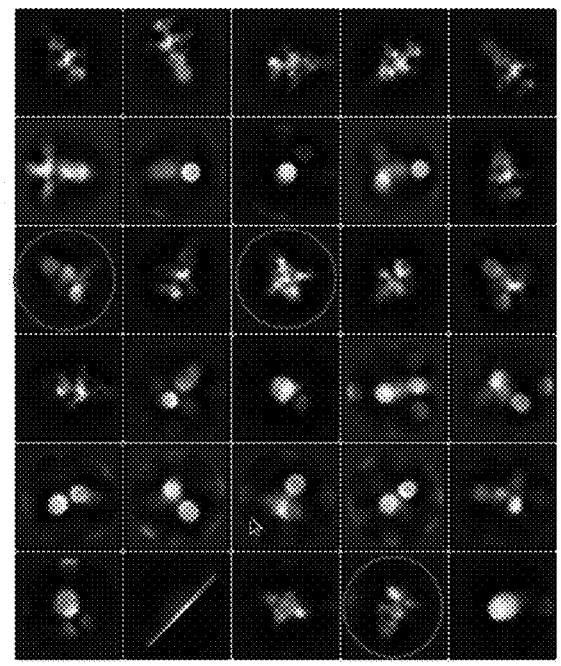

FIG. 2

```
  1  MESRIWCLVV  CVNLCIVCLG  AAVSSSSTRG  TSATHSHHSS  HTTSAAHSRS  GSVSQRVTSS
     MESRIWCLVV  CVNLCIVCLG  AAVSSSSTRG  TSATHSHHSS  HTTSAAHSRS  GSVSQRVTSS

61  QTVSHGVNET  IYNTTLKYGD  VVGVNTTKYP  YRVCSMAQGT  DLIRFERNIV  CTSMKPINED
     QTVSHGVNET  IYNTTLKYGD  VVGVNTTKYP  YRVCSMAQGT  DLIRFERNIV  CTSMKPINED

121  LDEGIMVVYK  RNIVAHTFKV  RVYQKVLTFR  RSYAYIHTTY  LLGSNTEYVA  PPMWEIHHIN
     LDEGIMVVYK  RNIVAHTFKV  RVYQKVLTFR  RSYAYIHTTY  LLGSNTEYVA  PPMWEIHHIN

181  SHSQCYSSYS  RVIAGTVFVA  YHRDSYENKT  MQLMPDDYSN  THSTRYVTVK  DQWHSRGSTW
     SHSQCYSSYS  RVIAGTVFVA  YHRDSYENKT  MQLMPDDYSN  THSTRYVTVK  DQWHSRGSTW

241  LYRETCNLNC  MVTITTARSK  YPYHFFATST  GDVVDISPFY  NGTNRNASYF  GENADKFFIF
     LYRETCNLNC  MVTITTARSK  YPYHFFATST  GDVVDISPFY  NGTNRNASYF  GENADKFFIF

301  PNYTIVSDFG  RPNSALETHR  LVAFLERADS  VISWDIQDEK  NVTCQLTFWE  ASERTIRSEA
     PNYTIVSDFG  RPNSALETHR  LVAFLERADS  VISWDIQDEK  NVTCQLTFWE  ASERTIRSEA

361  EDSYHFSSAK  MTATFLSKKQ  EVNMSDSALD  CVRDEAINKL  QQIFNTSYNQ  TYEKYGNVSV
     EDSYHFSSAK  MTATFLSKKQ  EVNMSDSALD  CVRDEAINKL  QQIFNTSYNQ  TYEKYGNVSV

421  FETTGGLVVF  WQGIKQKSLV  ELERLANRSS  LNLTHNRTKR  STDGNNATHL  SNMESVHNLV
     FETTGGLVVF  WQGIKQKSLV  ELERLANRSS  LNLTHNRTKR  STDGNNATHL  SNMESVHNLV

481  YAQLQFTYDT  LRGYINRALA  QIAEAWCVDQ  RRTLEVFKEL  SKINPSAILS  AIYNKPIAAR
     YAQLQFTYDT  LRGYINRALA  QIAEAWCVDQ  RRTLEVFKEL  SKINPSAILS  AIYNKPIAAR

541  FMGDVLGLAS  CVTINQTSVK  VLRDMNVKES  PGRCYSRPVV  IFNFANSSYV  QYGQLGEDNE
     FMGDVLGLAS  CVTINQTSVK  VLRDMNVKES  PGRCYSRPVV  IFNFANSSYV  QYGQLGEDNE

601  ILLGNHRTEE  CQLPSLKIFI  AGNSAYEYVD  YLFKRMIDLS  SISTVDSMIA  LDIDPLENTD
     ILLGNHRTEE  CQLPSLKIFI  AGNSAYEYVD  YLFKRMIDLS  SISTVDSMIA  LDIDPLENTD

661  FRVLELYSQK  ELRSSNVFDL  EEIMREFNSY  KQRVKYVEDK  VVDPLPPYLK  GLDDLMSGLG
     FRVLELYSQK  ELRSSNVFDL  EEIMREFNSY  KQRVKYVEDK  VVDPLPPYLK  GLDDLMSGLG

721  AAGKAVGVAI  GAVGGAVASV  VEGVATFLKN  PFGAFTIILV  AIAVVIIIYL  IYTRQRRLCM
     AAGKAVGVAI  GAVGGAVASV  VEGVATFLKN  PFGAFTIILV  AIAVVIIIYL  IYTRQRRLCM

781  QPLQNLFPYL  VSADGTTVTS  GNTKDTSLQA  PPSYEESVYN  SGRKGPGPPS  SDASTAAPPY
     QPLQNLFPYL  VSADGTTVTS  GNTKDTSLQA  PPSYEESVYN  SGRKGPGPPS  SDASTAAPPY

841  TNEQAYQMLL  ALVRLDAEQR  AQQNGTDSLD  GQTGTQDKGQ  KPNLLDRLRH  RKNGYRHLKD
     TNEQAYQMLL  ALVRLDAEQR  AQQNGTDSLD  GQTGTQDKGQ  KPNLLDRLRH  RKNGYRHLKD

901  SDEEENV
     SDEEENV
```

FIG. 4
A    B
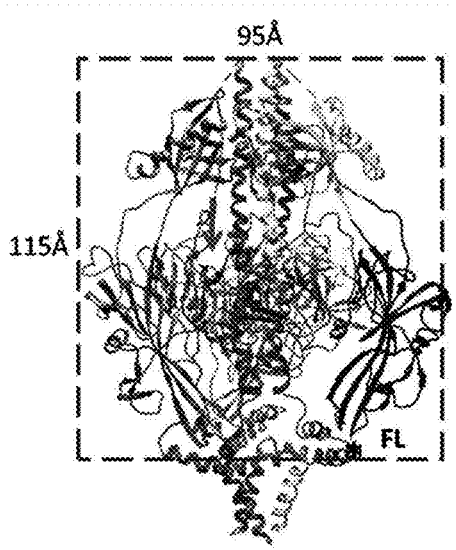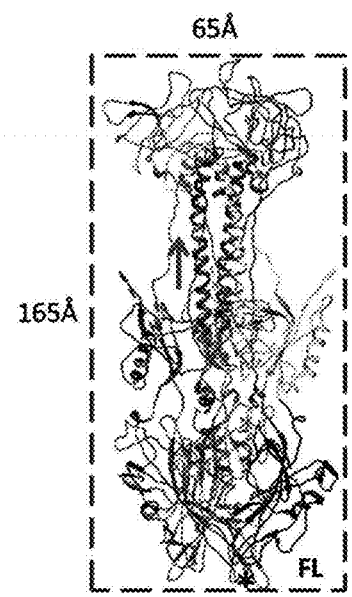

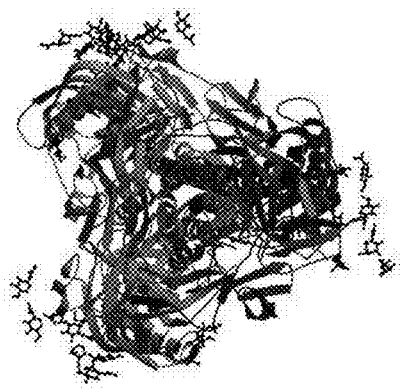

>5CXF:A|PDBID|CHAIN|SEQUENCE
YGDVVGVNTTKYPYRVCSMAQGTDLIRFERNIICTSMKPINEDLDEGIMVVYKRNIVAHTFKVRVYQKVLTFRRSYAGHR
TTYLLGSNTEYVAPPMWEIHHINKFAQCYSSYSRVIGGTVFVAYHRDSHENKTMQLIPDDYSNTHSTRYVTVKDQWHSRG
STATHRETCNLNCMLTITTARSKYPYHFFATSTGDVVYISPFYNGTNRNASYFGENADKFFIFPNYTIVSDFGRPNAAPE
THRLVAFLERADSVISWDIQDEKNVTCQLTFWEASERTIRSEAEDSYHFSSAKMTATFLSKKQEVNMSDSALDCVRDEAI
NKLQQIFNTSYNQTYEKYGNVSVFETSGGLVVFWQGIKQKSLVELERLANRSSLNITHDDDDKSTSDNNTTHLSSMESVH
NLVYAQLQFTYDTLRGYINRALAQIAEAWCVDQRRTLEVFKELSKINPSAILSAIYNKPIAARFMGDVLGLASCVTINQT
SVKVLRDMNVKESPGRCYSRPVVIFNFANSSYVQYGQLGEDNEILLGNHRTEECQLPSLKIFIAGNSAYEYVDYLFKRMI
DLSSISTVDSMIALDIDPLENTDFRVLELYSQKELRSSNVFDLEEIMREFNSYKQRVKYVEDKVVDPLPP (SEQ ID NO: 107)

>5CXF:B|PDBID|CHAIN|SEQUENCE
YGDVVGVNTTKYPYRVCSMAQGTDLIRFERNIICTSMKPINEDLDEGIMVVYKRNIVAHTFKVRVYQKVLTFRRSYAGHR
TTYLLGSNTEYVAPPMWEIHHINKFAQCYSSYSRVIGGTVFVAYHRDSHENKTMQLIPDDYSNTHSTRYVTVKDQWHSRG
STATHRETCNLNCMLTITTARSKYPYHFFATSTGDVVYISPFYNGTNRNASYFGENADKFFIFPNYTIVSDFGRPNAAPE
THRLVAFLERADSVISWDIQDEKNVTCQLTFWEASERTIRSEAEDSYHFSSAKMTATFLSKKQEVNMSDSALDCVRDEAI
NKLQQIFNTSYNQTYEKYGNVSVFETSGGLVVFWQGIKQKSLVELERLANRSSLNITHDDDDKSTSDNNTTHLSSMESVH
NLVYAQLQFTYDTLRGYINRALAQIAEAWCVDQRRTLEVFKELSKINPSAILSAIYNKPIAARFMGDVLGLASCVTINQT
SVKVLRDMNVKESPGRCYSRPVVIFNFANSSYVQYGQLGEDNEILLGNHRTEECQLPSLKIFIAGNSAYEYVDYLFKRMI
DLSSISTVDSMIALDIDPLENTDFRVLELYSQKELRSSNVFDLEEIMREFNSYKQRVKYVEDKVVDPLPP (SEQ ID NO: 108)

>5CXF:C|PDBID|CHAIN|SEQUENCE
YGDVVGVNTTKYPYRVCSMAQGTDLIRFERNIICTSMKPINEDLDEGIMVVYKRNIVAHTFKVRVYQKVLTFRRSYAGHR
TTYLLGSNTEYVAPPMWEIHHINKFAQCYSSYSRVIGGTVFVAYHRDSHENKTMQLIPDDYSNTHSTRYVTVKDQWHSRG
STATHRETCNLNCMLTITTARSKYPYHFFATSTGDVVYISPFYNGTNRNASYFGENADKFFIFPNYTIVSDFGRPNAAPE
THRLVAFLERADSVISWDIQDEKNVTCQLTFWEASERTIRSEAEDSYHFSSAKMTATFLSKKQEVNMSDSALDCVRDEAI
NKLQQIFNTSYNQTYEKYGNVSVFETSGGLVVFWQGIKQKSLVELERLANRSSLNITHDDDDKSTSDNNTTHLSSMESVH
NLVYAQLQFTYDTLRGYINRALAQIAEAWCVDQRRTLEVFKELSKINPSAILSAIYNKPIAARFMGDVLGLASCVTINQT
SVKVLRDMNVKESPGRCYSRPVVIFNFANSSYVQYGQLGEDNEILLGNHRTEECQLPSLKIFIAGNSAYEYVDYLFKRMI
DLSSISTVDSMIALDIDPLENTDFRVLELYSQKELRSSNVFDLEEIMREFNSYKQRVKYVEDKVVDPLPP (SEQ ID NO: 109)

FIG. 9

\>HAN13 gi|242345614|gb|GQ221973.1|:81988-84705 Human herpesvirus 5 strain HAN13, complete genome reverse complement
MESRIWCLVVCVNLCIVCLGAAVSSSSTSHATSSAHNGSHTSRTTSAQTRSVSSQHVTSS
EAVSHRANETIYNTTLKYGDVVGVNTTKYPYRVCSMAQGTDLIRFERNIVCTPMKPINED
LDEGIMVVYKRNIVAHTFKVRVYQKVLTFRRSYAYIHTTYLLGSNTEYVAPPMWEIHHIN
RHSQCYSSYSRVIAGTVFVAYHRDSYENKTMQLMLDDYSNTHSTRYVTVKDQWHSRGSTW
LYRETCNLNCMVTITTARSKYPYHFFATSTGDVVDISPFYNGTNRNTSYFGENADKFFIF
PNYTIVSDFGRANSAPETHRLVAFLERADSVISWDIQDEKNVTCQLTFWEASERTIRSEA
EDSYHFSSAKMTATFLSKKQEVNMSDPVLDCVRDQALNKLQQIFNASYNQTYEKYGNVSV
FETTGGLVVFWQGIKQKSLLELERLANSSGVNSTRRTKRSTGNTTTLSLESESVRNVLYA
QLQFTYDTLRSYINRALAQIAEAWCVDQRRTLEVFKELSKINPSAILSAIYNKPIAARFM
GDVLGLASCVTINQTSVKVLRDMNVKESPGRCYSRPVVIFNFVNSSYVQYGQLGEDNEIL
LGNHRTEECQFPSLKIFIAGNSAYEYVDYLFKRMIDLSSISTVDSMIALDIDPLENTDFR
VLELYSQKELRSSNVFDLEEIMREFNSYKQRVKYVEDKVVDPLPPYLKGLDDLMSGLGAA
GKAVGVAIGAVGGAVASVVEGVATFLKNPFGAFTIILVAIAVVIIIYLIYTRQRRLCMQP
LQNLFPYLVSADGTTVTSGNTKDTSLQAPPSYEESVYNSGRKGPGPPSSDASTAAPPYTN
EQAYQMLLALARLDAEQRAQQNGTDSLDGQTGTQDKGQKPNLLDRLRHRKNGYRHLKDSD
EEENV (SEQ ID NO: 110)

\>VR1814 gi|270355759|gb|GU179289.1|:81925-84642 Human herpesvirus 5 strain VR1814, complete genome reverse complement
MESRIWCLVVCVNLCIVCLGAVVSSSSTSHATSSAHNGSHTSRTTSAQTRSVSSQHVTSS
EAVSHRANETIYNTTLKYGDVVGVNTTKYPYRVCSMAQGTDLIRFERNIVCTPMKPINED
LDEGIMVVYKRNIVAHTFKVRVYQKVLTFRRSYAYIHTTYLLGSNTEYVAPPMWEIHHIN
RHSQCYSSYSRVIAGTVFVAYHRDSYENKTMQLMLDDYSNTHSTRYVTVKDQWHSRGSTW
LYRETCNLNCMVTITTARSKYPYHFFATSTGDVVDISPFYNGTNRNTSYFGENADKFFIF
PNYTIVSDFGRANSAPETHRLVAFLERADSVISWDIQDEKNVTCQLTFWEASERTIRSEA
EDSYHFSSAKMTATFLSKKQEVNMSDPVLDCVRDQALNKLQQIFNASYNQTYEKYGNVSV
FETTGGLVVFWQGIKQKSLLELERLANSSGVNSTRRTKRSTGNTTTLSLESESVRNVLYA
QLQFTYDTLRSYINRALAQIAEAWCVDQRRTLEVFKELSKINPSAILSAIYNKPIAARFM
GDVLGLASCVTINQTSVKVLRDMNVKESPGRCYSRPVVIFNFVNSSYVQYGQLGEDNEIL
LGNHRTEECQFPSLKIFIAGNSAYEYVDYLFKRMIDLSSISTVDSMIALDIDPLENTDFR
VLELYSQKELRSSNVFDLEEIMREFNSYKQRVKYVEDKVVDPLPPYLKGLDDLMSGLGAA
GKAVGVAIGAVGGAVASVVEGVATFLKNPFGAFTIILVAIAVVIIIYLIYTRQRRLCMQP
LQNLFPYLVSADGTTVTSGNTKDTSLQAPPSYEESVYNSGRKGPGPPSSDASTAAPPYTN
EQAYQMLLALARLDAEQRAQQNGTDSLDGQTGTQDKGQKPNLLDRLRHRKNGYRHLKDSD
EEENV (SEQ ID NO: 111)

FIG. 10

Original HCMV gB (Towne) sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 1)
``` gB-001 Q98C, G271C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMACGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST CDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 2)
``` gB-002 Q98C, I653C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMACGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDCDPLENTD
```

FIG. 10 (Continued)

```
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV
```
(SEQ ID NO: 3)

gB-003 G99C, A267C

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQCT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFCTST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV
```
(SEQ ID NO: 4)

gB-004 T100C, A267C

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGC DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFCTST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV
```
(SEQ ID NO: 5)

gB-005 T100C, S269C

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGC DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATCT GDVVDISPFY NGTNRNASYF GENADKFFIF
```

FIG. 10 (Continued)

```
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 6)
``` gB-006 T100C, L651C

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGC DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA CDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 7)
``` gB-007 D217C, F584C

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDCYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNCANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 8)
```

FIG. 10 (Continued)

gB-008 Y218C, A585C
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDCSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFCNSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 9)
``` gB-009 S219C, D654C
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYCN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDICPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 10)
``` gB-010 N220C, D652C
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSC THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LCIDPLENTD
```

FIG. 10 (Continued)

```
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 11)
``` gB-011 T221C, D652C

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN CHSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LCIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 12)
``` gB-012 W240C, G718C

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTC
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSCLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 13)
``` gB-013 Y242C, K710C

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LCRETCNLNC MVTITTARSK YPYHFFATST GDVVDISPFY NGTNRNASYF GENADKFFIF
```

FIG. 10 (Continued)

```
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLC GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 14)
``` gB-014 Y242C, D714C

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LCRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDCLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 15)
``` gB-015 S269C, I653C

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATCT GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDCDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 16)
```

FIG. 10 (Continued)

gB-016 G271C, P614C
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST CDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLCSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV
```
(SEQ ID NO: 17)

gB-017 S367C, L499C
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFCSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRACA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV
```
(SEQ ID NO: 18)

gB-018 T372C, W506C
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MCATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEACCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
```

FIG. 10 (Continued)

```
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV
```
(SEQ ID NO: 19)

gB-019 F541C, Q669C
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 CMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSCK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV
```
(SEQ ID NO: 20)

gB-020 L548C, A650C
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGCAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIC LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV
```
(SEQ ID NO: 21)

gB-021 A549C, I653C
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
```

FIG. 10 (Continued)

```
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLCS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDCDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV
```
(SEQ ID NO: 22)

gB-022 S550C, D652C
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAC CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LCIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV
```
(SEQ ID NO: 23)

gB-023 G604C, F661C
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLCNHRTEE CQLPSLKIFI AGNSAYEYVD YLFKRMIDLS SISTVDSMIA LDIDPLENTD
661 CRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV
```
(SEQ ID NO: 24)

gB-024 N605C, E665C
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
```

FIG. 10 (Continued)

```
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGCHRTEE CQLPSLKIFI AGNSAYEYVD YLFKRMIDLS SISTVDSMIA LDIDPLENTD
661 FRVLCLYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 25)
``` gB-025 R607C, S675C

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHCTEE CQLPSLKIFI AGNSAYEYVD YLFKRMIDLS SISTVDSMIA LDIDPLENTD
661 FRVLELYSQK ELRSCNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 26)
``` gB-026 T608C, D679C

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRCEE CQLPSLKIFI AGNSAYEYVD YLFKRMIDLS SISTVDSMIA LDIDPLENTD
661 FRVLELYSQK ELRSSNVFCL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
```

FIG. 10 (Continued)

901 SDEEENV (SEQ ID NO: 27)

gB-027 E609C, F678C
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTCE CQLPSLKIFI AGNSAYEYVD YLFKRMIDLS SISTVDSMIA LDIDPLENTD
661 FRVLELYSQK ELRSSNVCDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 28)

gB-028 R673C, S674C
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELCCSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 29)

gB-029 N676C, V677C
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR

FIG. 10 (Continued)

```
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSCCFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 30)
``` gB-030 L680C, E681C

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDC CEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 31)
``` gB-031 I683C, M684C

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EECCREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 32)
``` gB-032 F687C, N688C

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
```

FIG. 10 (Continued)

241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMRECCSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 33)

gB-033 Y690C, K691C
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSC CQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 34)

gB-034 K695C, K724C
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVCYVEDK VVDPLPPYLK GLDDLMSGLG
721 AAGCAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 35)

1 MESRIWCLVV CVNLCIVCLG AAVSSSSTRG TSATHSHHSS HTTSAAHSRS GSVSQRVTSS
     61 QTVSHGVNET IYNTTLKYGD VVGVNTTKYP YRVCSMAQGT DLIRFERNIV CTSMKPINED
    121 LDEGIMVVYK RNIVAHTFKV RVYQKVLTFR RSYAYIHTTY LLGSNTEYVA PPMWEIHHIN
    181 SHSQCYSSYS RVIAGTVFVA YHRDSYENKT MQLMPDDYSN THSTRYVTVK DQWHSRGSTW
    241 LYRETCNLNC MVTITTARSK YPYHFFATST GDVVDISPFY NGTNRNASYF GENADKFFIF
    301 PNYTIVSDFG RPNSALETHR LVAFLERADS VISWDIQDEK NVTCQLTFWE ASERTIRSEA
    361 EDSYHFSSAK MTATFLSKKQ EVNMSDSALD CVRDEAINKL QQIFNTSYNQ TYEKYGNVSV
    421 FETTGGLVVF WQGIKQKSLV ELERLANRSS LNLTHNRTKR STDGNNATHL SNMESVHNLV
    481 YAQLQFTYDT LRGYINRALA QIAEAWCVDQ RRTLEVFKEL SKINPSAILS AIYNKPIAAR
    541 FMGDVLGLAS CVTINQTSVK VLRDMNVKES PGRCYSRPVV IFNFANSSYV QYGQLGEDNE
    601 ILLGNHRTEE CQLPSLKIFI AGNSAYEYVD YLFKRMIDLS SISTVDSMIA LDIDPLENTD
    661 FRVLELYSQK ELRSSNVFDL EEIMREFNSY KQRVKYVEDK VVDPLPPYLK GLDDLMSGLG
    721 AAGKAVGVAI GAVGGAVASV VEGVACCLKN PFGAFTIILV AIAVVIIIYL IYTRQRRLCM
    781 QPLQNLFPYL VSADGTTVTS GNTKDTSLQA PPSYEESVYN SGRKGPGPPS SDASTAAPPY
    841 TNEQAYQMLL ALVRLDAEQR AQQNGTDSLD GQTGTQDKGQ KPNLLDRLRH RKNGYRHLKD
    901 SDEEENV (SEQ ID NO: 36)

gB-036 K749C, N750C

1 MESRIWCLVV CVNLCIVCLG AAVSSSSTRG TSATHSHHSS HTTSAAHSRS GSVSQRVTSS
     61 QTVSHGVNET IYNTTLKYGD VVGVNTTKYP YRVCSMAQGT DLIRFERNIV CTSMKPINED
    121 LDEGIMVVYK RNIVAHTFKV RVYQKVLTFR RSYAYIHTTY LLGSNTEYVA PPMWEIHHIN
    181 SHSQCYSSYS RVIAGTVFVA YHRDSYENKT MQLMPDDYSN THSTRYVTVK DQWHSRGSTW
    241 LYRETCNLNC MVTITTARSK YPYHFFATST GDVVDISPFY NGTNRNASYF GENADKFFIF
    301 PNYTIVSDFG RPNSALETHR LVAFLERADS VISWDIQDEK NVTCQLTFWE ASERTIRSEA
    361 EDSYHFSSAK MTATFLSKKQ EVNMSDSALD CVRDEAINKL QQIFNTSYNQ TYEKYGNVSV
    421 FETTGGLVVF WQGIKQKSLV ELERLANRSS LNLTHNRTKR STDGNNATHL SNMESVHNLV
    481 YAQLQFTYDT LRGYINRALA QIAEAWCVDQ RRTLEVFKEL SKINPSAILS AIYNKPIAAR
    541 FMGDVLGLAS CVTINQTSVK VLRDMNVKES PGRCYSRPVV IFNFANSSYV QYGQLGEDNE
    601 ILLGNHRTEE CQLPSLKIFI AGNSAYEYVD YLFKRMIDLS SISTVDSMIA LDIDPLENTD
    661 FRVLELYSQK ELRSSNVFDL EEIMREFNSY KQRVKYVEDK VVDPLPPYLK GLDDLMSGLG
    721 AAGKAVGVAI GAVGGAVASV VEGVATFLCC PFGAFTIILV AIAVVIIIYL IYTRQRRLCM
    781 QPLQNLFPYL VSADGTTVTS GNTKDTSLQA PPSYEESVYN SGRKGPGPPS SDASTAAPPY
    841 TNEQAYQMLL ALVRLDAEQR AQQNGTDSLD GQTGTQDKGQ KPNLLDRLRH RKNGYRHLKD
    901 SDEEENV (SEQ ID NO: 37)

gB-037 K670L

1 MESRIWCLVV CVNLCIVCLG AAVSSSSTRG TSATHSHHSS HTTSAAHSRS GSVSQRVTSS
     61 QTVSHGVNET IYNTTLKYGD VVGVNTTKYP YRVCSMAQGT DLIRFERNIV CTSMKPINED
    121 LDEGIMVVYK RNIVAHTFKV RVYQKVLTFR RSYAYIHTTY LLGSNTEYVA PPMWEIHHIN
    181 SHSQCYSSYS RVIAGTVFVA YHRDSYENKT MQLMPDDYSN THSTRYVTVK DQWHSRGSTW
    241 LYRETCNLNC MVTITTARSK YPYHFFATST GDVVDISPFY NGTNRNASYF GENADKFFIF
    301 PNYTIVSDFG RPNSALETHR LVAFLERADS VISWDIQDEK NVTCQLTFWE ASERTIRSEA
    361 EDSYHFSSAK MTATFLSKKQ EVNMSDSALD CVRDEAINKL QQIFNTSYNQ TYEKYGNVSV
    421 FETTGGLVVF WQGIKQKSLV ELERLANRSS LNLTHNRTKR STDGNNATHL SNMESVHNLV
    481 YAQLQFTYDT LRGYINRALA QIAEAWCVDQ RRTLEVFKEL SKINPSAILS AIYNKPIAAR
    541 FMGDVLGLAS CVTINQTSVK VLRDMNVKES PGRCYSRPVV IFNFANSSYV QYGQLGEDNE
    601 ILLGNHRTEE CQLPSLKIFI AGNSAYEYVD YLFKRMIDLS SISTVDSMIA LDIDPLENTD
    661 FRVLELYSQL ELRSSNVFDL EEIMREFNSY KQRVKYVEDK VVDPLPPYLK GLDDLMSGLG

FIG. 10 (Continued)

```
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV
```
(SEQ ID NO: 38)

gB-038 K670F
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQF ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV
```
(SEQ ID NO: 39)

gB-039 R673L
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELLSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV
```
(SEQ ID NO: 40)

gB-040 R673F
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
```

FIG. 10 (Continued)

```
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELFSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 41)
``` gB-041 K691L

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY LQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 42)
``` gB-042 K691F

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY FQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 43)
``` gB-043 M96C, D660C sequence

```
  1 MESRIWCLVV CVNLCIVCLG AAVSSSSTRG TSATHSHHSS HTTSAAHSRS GSVSQRVTSS
```

FIG. 10 (Continued)

```
 61 QTVSHGVNET IYNTTLKYGD VVGVNTTKYP YRVCSCAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTC
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 47)
``` gB-044 Q98C, N658C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMACGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLECTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 48)
``` gB-045 T100C, R258C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGC DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTACSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
```

FIG. 10 (Continued)

```
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 49)
``` gB-046 T100C, L656C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGC DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPCENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 50)
``` gB-047 T100C, N658C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGC DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLECTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 51)
``` gB-048 I117C, T406C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPCNED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNCSYNQ TYEKYGNVSV
```

FIG. 10 (Continued)

```
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 52)
``` gB-049 I117C, S407C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPCNED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTCYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 53)
``` gB-050 Y153C, L712C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSCAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GCDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 54)
``` gB-051 L162C, M716C sequence

```
  1 MESRIWCLVV CVNLCIVCLG AAVSSSSTRG TSATHSHHSS HTTSAAHSRS GSVSQRVTSS
```

FIG. 10 (Continued)

```
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LCGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLCSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 55)
``` gB-052 D217C, S587C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDCYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANCSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 56)
``` gB-053 D217C, Y589C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDCYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSCV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
```

FIG. 10 (Continued)

```
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 57)
``` gB-054 S219C, F584C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYCN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNCANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 58)
``` gB-055 S219C, A585C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYCN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFCNSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 59)
``` gB-056 S219C, N586C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYCN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
```

FIG. 10 (Continued)

```
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFACSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 60)
``` gB-057 N220C, T659C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSC THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENCD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 61)
``` gB-058 S223C, T659C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THCTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENCD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 62)
``` gB-059 W240C, A732C sequence

```
  1 MESRIWCLVV CVNLCIVCLG AAVSSSSTRG TSATHSHHSS HTTSAAHSRS GSVSQRVTSS
```

FIG. 10 (Continued)

```
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTC
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GCVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 63)
``` gB-060 W240C, G735C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTC
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGCAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 64)
``` gB-061 Y242C, V728C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LCRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGCAI GAVGGAVASV VEGVATFLKN PFGAFTIILV AIAVVIIIYL IYTRQRRLCM
```

FIG. 10 (Continued)

```
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 65)
``` gB-062 Y242C, G731C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LCRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI CAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 66)
``` gB-063 R258C, L656C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTACSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPCENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 67)
``` gB-064 S269C, L656C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATCT GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
```

FIG. 10 (Continued)

```
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPCENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 68)
``` gB-065 S269C, N658C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATCT GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLECTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 69)
``` gB-066 D272C, P614C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GCVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLCSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 70)
``` gB-067 V273C, V629C sequence
```
  1 MESRIWCLVV CVNLCIVCLG AAVSSSSTRG TSATHSHHSS HTTSAAHSRS GSVSQRVTSS
```

FIG. 10 (Continued)

```
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDCVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYCD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 71)
``` gB-068 W349C, A650C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFCE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIC LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 72)
``` gB-069 S367C, A500C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFCSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALC QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
```

FIG. 10 (Continued)

781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 73)

gB-070 S367C, A503C sequence
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFCSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QICEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 74)

gB-071 K370C, Q501C sequence
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAC MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA CIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 75)

gB-072 K522C, I683C sequence
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV

FIG. 10 (Continued)

```
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SCINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EECMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 76)
``` gB-073 I523C, I683C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKCNPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EECMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 77)
``` gB-074 I523C, M684C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKCNPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEICREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 78)
``` gB-075 N524C, M684C sequence

```
  1 MESRIWCLVV CVNLCIVCLG AAVSSSSTRG TSATHSHHSS HTTSAAHSRS GSVSQRVTSS
```

FIG. 10 (Continued)

```
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKICPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEICREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 79)
``` gB-076 P525C, E681C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINCSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL CEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 80)
``` gB-077 R540C, L680C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAC
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDC EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
```

FIG. 10 (Continued)

781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 81)

gB-078 F541C, L680C sequence
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 CMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDC EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 82)

gB-079 L548C, P655C sequence
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGCAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDCLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 83)

gB-080 A549C, N658C sequence
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV

FIG. 10 (Continued)

```
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLCS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLECTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 84)
``` gB-081 S550C, P655C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAC CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDCLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 85)
``` gB-082 S550C, E657C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAC CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLCNTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 86)
``` gB-083 Q591C, S668C sequence

```
  1 MESRIWCLVV CVNLCIVCLG AAVSSSSTRG TSATHSHHSS HTTSAAHSRS GSVSQRVTSS
```

FIG. 10 (Continued)

```
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV CYGQLGEDNE
601 ILLGNHRTEE CQLPSLKIFI AGNSAYEYVD YLFKRMIDLS SISTVDSMIA LDIDPLENTD
661 FRVLELYCQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 87)
``` gB-084 L603C, Y667C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILCGNHRTEE CQLPSLKIFI AGNSAYEYVD YLFKRMIDLS SISTVDSMIA LDIDPLENTD
661 FRVLELCSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 88)
``` gB-085 G604C, L672C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLCNHRTEE CQLPSLKIFI AGNSAYEYVD YLFKRMIDLS SISTVDSMIA LDIDPLENTD
661 FRVLELYSQK ECRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
```

FIG. 10 (Continued)

```
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 89)
``` gB-086 R607C, N688C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHCTEE CQLPSLKIFI AGNSAYEYVD YLFKRMIDLS SISTVDSMIA LDIDPLENTD
661 FRVLELYSQK ELRSSNVFDL EEIMREFCSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 90)
``` gB-087 T608C, Q692C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRCEE CQLPSLKIFI AGNSAYEYVD YLFKRMIDLS SISTVDSMIA LDIDPLENTD
661 FRVLELYSQK ELRSSNVFDL EEIMREFNSY KCRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 91)
``` gB-088 E609C, K691C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
```

FIG. 10 (Continued)

```
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTCE CQLPSLKIFI AGNSAYEYVD YLFKRMIDLS SISTVDSMIA LDIDPLENTD
661 FRVLELYSQK ELRSSNVFDL EEIMREFNSY CQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 92)
``` gB-089 E610C, S674C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEC CQLPSLKIFI AGNSAYEYVD YLFKRMIDLS SISTVDSMIA LDIDPLENTD
661 FRVLELYSQK ELRCSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 93)
``` gB-090 E610C, S675C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEC CQLPSLKIFI AGNSAYEYVD YLFKRMIDLS SISTVDSMIA LDIDPLENTD
661 FRVLELYSQK ELRSCNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 94)
``` gB-091 Q612C, V663C sequence
```
  1 MESRIWCLVV CVNLCIVCLG AAVSSSSTRG TSATHSHHSS HTTSAAHSRS GSVSQRVTSS
```

FIG. 10 (Continued)

```
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CCLPSLKIFI AGNSAYEYVD YLFKRMIDLS SISTVDSMIA LDIDPLENTD
661 FRCLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 95)
``` gB-092 V737C, F755C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGACASV VEGVATFLKN PFGACTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 96)
``` gB-093 V741C, A754C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV CEGVATFLKN PFGCFTIILV AIAVVIIIYL IYTRQRRLCM
```

FIG. 10 (Continued)

```
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 97)
``` gB-094 V741C, F755C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV CEGVATFLKN PFGACTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 98)
``` gB-095 D679S sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFSL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 99)
``` gB-096 D679N sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
```

FIG. 10 (Continued)

```
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFNL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 100)
``` gB-097 E682S sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL ESIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 101)
``` gB-098 E682Q sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EQIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 102)
``` gB-099 E686S sequence

```
  1 MESRIWCLVV CVNLCIVCLG AAVSSSSTRG TSATHSHHSS HTTSAAHSRS GSVSQRVTSS
```

FIG. 10 (Continued)

```
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMRSFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 103)
``` gB-100 E686Q sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMRQFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 104)
``` gB-101 N118P sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPIPED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
```

FIG. 10 (Continued)

```
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV
```
(SEQ ID NO: 105)

gB-102 D646P sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVPSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV
```
(SEQ ID NO: 106)

HUMAN CYTOMEGALOVIRUS GB POLYPEPTIDE

CROSS REFERENCE TO RELATED APPLICATIONS

This application claims the benefit under 35 U.S.C. § 119 of United States provisional applications 62/784,005, filed Dec. 21, 2018, the entire contents of which are incorporated herein by reference.

FIELD OF THE INVENTION

The present invention relates to human cytomegalovirus (HCMV) compositions and methods thereof.

BACKGROUND

Human cytomegalovirus (HCMV) is a double stranded DNA virus of the β-herpesvirus family. HCMV is the leading cause of congenital and neonatal hearing loss resulting from vertical virus transmission following infection or reactivation of latent virus in pregnant women. In addition, HCMV is a common opportunistic pathogen affecting immunosuppressed patients, such as solid organ and stem cell transplant patients, AIDS patients, etc. Though development of a vaccine against HCMV has been listed as a top priority by the Institute of Medicine, none has been licensed to date.

The HCMV genome encodes several envelope glycoproteins, one of which is glycoprotein B (gB). Glycoprotein B is a fusogen that is required for virus entry into cells and an important target for neutralizing antibody (nAb) responses to infection. HCMV vaccines that incorporate gB subunit antigens have been under development. Clinical studies have shown that some gB subunit-based vaccine candidates are safe and immunogenic, though improvements in protective efficacy and durability of protection are desirable.

Accordingly, safe and effective immunogenic compositions to protect against HCMV infection are needed. Diagnostic reagents to detect immune responses to HCMV, to guide the design of gB-based HCMV vaccines, and to support the development of therapeutic or prophylactic antibodies against HCMV are also needed.

SUMMARY OF THE INVENTION

To meet these and other needs, in one aspect, the present invention relates to a polypeptide that may be included in an immunogenic composition as an antigen to elicit an immune response to HCMV.

In another aspect, the invention relates to a polypeptide including at least one introduced amino acid mutation relative to the amino acid sequence of the wild-type HCMV glycoprotein B (gB). In some embodiments, the polypeptide includes a conformation that is not an HCMV gB postfusion conformation.

In another aspect, the invention relates to a polypeptide that binds to an HCMV gB prefusion-specific antibody.

In another aspect, the invention relates to a polypeptide that binds to a bis(aryl)thiourea compound. In some embodiments, the compound is N-{4-[({(1S)-1-[3,5-bis(trifluoromethyl)phenyl]ethyl}carbamothioyl)amino]phenyl}-1,3-thiazole-4-carboxamide.

In some embodiments, the polypeptide is characterized by structure coordinates including a root mean square deviation (RMSD) of conserved residue backbone atoms when superimposed on backbone atoms described by structural coordinates of Table 1.

In one aspect, the invention relates to a polypeptide including at least one amino acid mutation relative to the amino acid sequence of the wild-type HCMV gB polypeptide, wherein the amino acid mutation includes a cysteine substitution.

In another aspect, the invention relates to a polypeptide including at least one amino acid mutation relative to the amino acid sequence of the wild-type HCMV gB polypeptide, wherein the amino acid mutation includes a mutation that allows a disulfide bond to form.

In another aspect, the invention relates to a polypeptide including at least one amino acid mutation relative to the amino acid sequence of the wild-type HCMV gB polypeptide, wherein the amino acid mutation includes an electrostatic mutation.

In another aspect, the invention relates to a polypeptide including at least one amino acid mutation relative to the amino acid sequence of the wild-type HCMV gB polypeptide, wherein the amino acid mutation includes a phenylalanine substitution.

In another aspect, the invention relates to a polypeptide including at least one amino acid mutation relative to the amino acid sequence of the wild-type HCMV gB polypeptide, wherein the amino acid mutation includes a leucine substitution.

In another aspect, the invention relates to a polypeptide including at least one amino acid mutation relative to the amino acid sequence of the wild-type HCMV gB polypeptide, wherein the mutation stabilizes prefusion conformation of the polypeptide, and wherein the polypeptide specifically binds to an HCMV gB prefusion-specific antibody.

In another aspect, the invention relates to a polypeptide including a cysteine at any one of the amino acid positions listed in column (ii) of Table 2, as compared to SEQ ID NO: 1.

In another aspect, the invention relates to a polypeptide including an amino acid substitution at any one of the amino acid positions listed in column (ii) of Table 3, as compared to SEQ ID NO: 1.

In another aspect, the invention relates to a polypeptide including the mutations Q98C and I653C according to the numbering of SEQ ID NO: 1. In another aspect, the invention relates to a polypeptide including the mutations T100C and S269C according to the numbering of SEQ ID NO: 1. In another aspect, the invention relates to a polypeptide including the mutations D217C and F584C according to the numbering of SEQ ID NO: 1. In another aspect, the invention relates to a polypeptide including the mutations Y242C and K710C according to the numbering of SEQ ID NO: 1. In another aspect, the invention relates to a polypeptide including the mutations Y242C and D714C according to the numbering of SEQ ID NO: 1. In another aspect, the invention relates to a polypeptide including the mutations S367C and L499C according to the numbering of SEQ ID NO: 1. In another aspect, the invention relates to a polypeptide including the mutations T372C and W506C according to the numbering of SEQ ID NO: 1. In another aspect, the invention relates to a polypeptide including the mutations S550C and D652C according to the numbering of SEQ ID NO: 1. In another aspect, the invention relates to a polypeptide including the mutations T608C and D679C according to the numbering of SEQ ID NO: 1. In another aspect, the invention relates to a polypeptide including the mutations K695C and K724C according to the numbering of SEQ ID NO: 1.

In another aspect, the invention relates to a polypeptide including an amino acid sequence that is at least about 90% identical to the amino acid sequence set forth in any one of SEQ ID NOs: 1-43, wherein the polypeptide includes a mutation as compared to SEQ ID NO: 1.

In some embodiments, the polypeptide does not include a mutation at any one of the following positions: R562, P577, S587, Y588, G592, G595, L601/H605, C610, L612, P613, Y625, Y627, F632, and K633.

In some embodiments, the polypeptide does not include the cytoplasmic tail of HCMV gB. In some embodiments, the polypeptide does not include the transmembrane region. In some embodiments, the polypeptide includes the cytoplasmic tail of HCMV gB and does not include the transmembrane region.

In some embodiments, the polypeptide does not contain an insect cell pattern of glycosylation.

In some embodiments, the polypeptide exhibits improved solubility or stability, as compared to a native gB in a postfusion conformation.

In some embodiments, the polypeptide is immunogenic.

In another aspect, the invention relates to a nucleic acid encoding the polypeptide according to any one of embodiments described herein. In some embodiments, the nucleic acid includes a self-replicating RNA molecule. In some embodiments, the nucleic acid includes a modified RNA molecule. In another aspect, the invention relates to a composition including a nucleic acid according to any one of the embodiments described herein.

In another aspect, the invention relates to a composition including the polypeptide according to any one of embodiments described herein, and further including a CMV antigen. In some embodiments, the composition further includes any one of the following polypeptides: gO, gH, gL, pUL128, pUL130, pUL131, and any combination thereof. In some embodiments, the composition further includes a diluent. In some embodiments, the composition further includes an adjuvant. In some embodiments, the composition is immunogenic. In some embodiments, the composition is for use in eliciting an immune response against cytomegalovirus.

In another aspect, the invention relates to a method of eliciting an immune response in a mammal. The method includes administering to the mammal an effective amount of the polypeptide according to any one of the embodiments described herein.

In another aspect, the invention relates to a method for reducing cytomegalovirus viral shedding in a mammal. The method includes administering to the mammal an effective amount of the polypeptide according to any one of the embodiments described herein.

In another aspect, the invention relates to a composition including a polynucleotide that may elicit an immune response in a mammal. The polynucleotide encodes at least one polypeptide of interest, e.g., an antigen. Antigens disclosed herein may be wild type (i.e., derived from the infectious agent) or preferably modified (e.g., engineered, designed or artificial). The nucleic acid molecules described herein, specifically polynucleotides, in some embodiments, encode one or more peptides or polypeptides of interest. Such peptides or polypeptides may serve as an antigen or antigenic molecule. The term "nucleic acid" includes any compound that includes a polymer of nucleotides. These polymers are referred to as "polynucleotides." Exemplary nucleic acids or polynucleotides of the invention include, but are not limited to, ribonucleic acids (RNAs), including mRNA, and deoxyribonucleic acids (DNAs).

In some embodiments, the composition includes DNA encoding a polypeptide or fragment thereof described herein. In some embodiments, the composition includes RNA encoding a polypeptide or fragment thereof described herein. In some embodiments, the composition includes an mRNA polynucleotide encoding a polypeptide or fragment thereof described herein. Such compositions may produce the appropriate protein conformation upon translation.

In one aspect, the invention relates to a composition that includes at least one polynucleotide encoding a polypeptide including at least one amino acid mutation relative to the amino acid sequence of the wild-type HCMV gB.

In some embodiments, the invention relates to a composition that includes at least one polynucleotide encoding at least one hCMV gB polypeptide or an immunogenic fragment or epitope thereof.

In some embodiments, the composition includes at least one polynucleotide encoding two or more additional polypeptides or an immunogenic fragment or epitope thereof. In some embodiments, the composition includes two or more polynucleotides encoding two or more additional polypeptides or immunogenic fragments or epitopes thereof. The one or more additional polypeptides may be encoded on a single polynucleotide or may be encoded individually on multiple (e.g., two or more) polynucleotides.

In another aspect, the invention relates to a composition that includes (a) a polypeptide including at least one introduced amino acid mutation relative to the amino acid sequence of the wild-type HCMV glycoprotein B (gB); and (b) an additional polypeptide, preferably an HCMV polypeptide, more preferably an HCMV antigenic polypeptide. The additional polypeptide may be selected from gH, gL, gB, gO, gN, and gM and an immunogenic fragment or epitope thereof. In some embodiments, the additional polypeptide is pp65. In some embodiments, the additional polypeptide may be selected from gH, gL, gO, gM, gN, UL128, UL130, and UL131A, and fragments thereof. In another aspect, the invention relates to a composition that includes (a) a polynucleotide encoding a polypeptide including at least one introduced amino acid mutation relative to the amino acid sequence of the wild-type HCMV glycoprotein B (gB); and (b) a polynucleotide encoding an additional polypeptide, preferably an HCMV antigenic polypeptide. The additional polypeptide may be selected from HCMV gH, gL, gB, gO, gN, and gM and an immunogenic fragment or epitope thereof. In some embodiments, the additional polypeptide is HCMV pp65. In some embodiments, the additional polypeptide may be selected from HCMV gH, gL, gO, gM, gN, UL128, UL130, and UL131A, and fragments thereof.

In another aspect, the invention relates to methods of inducing an immune response in a mammal, including administering to the mammal a composition in an amount effective to induce an immune response, wherein the composition includes a polynucleotide encoding a polypeptide including at least one introduced amino acid mutation relative to the amino acid sequence of the wild-type HCMV gB. The composition disclosed herein may be formulated in an effective amount to produce an antigen specific immune response in a mammal.

BRIEF DESCRIPTION OF THE DRAWINGS

FIG. 1A-B—Two-dimensional (2D) class averages of gB conformers. Left panel (FIG. 1A, 2D projections from a postfusion gB structure). Projection images of an electron cryomicroscopy structure of postfusion gB bound with antibody Fabs are shown. Right panel (FIG. 1B, 2D class averages). Two dimensional class averages from electron cryomicroscopy images obtained from a preparation of gB extracted from CMV virions after treatment with a fusion inhibitor and a cross-linker and binding of an antibody fragment are shown on the right. Class averaged images that do not resemble any of the reference postfusion gB two dimensional projections are identified by red circles.

FIG. 2—Glycoprotein B amino acids included in the prefusion and postfusion gB-Fab complex models from our electron cryomicroscopy structures. The amino acids that can be modeled in the electron cryomicroscopy density maps are highlighted with the domain color codes (Domain I (italics only, i.e., upper sequence (prefusion) residues X-X; lower sequence (post-fusion) residues Y-Y); Domain II (bold and underlined, i.e., upper sequence (prefusion) residues X-X; lower sequence (post-fusion) residues Y-Y); Domain III (bold only, i.e., upper sequence (prefusion) residues X-X; lower sequence (post-fusion) residues Y-Y); Domain IV (italics and underlined, i.e., upper sequence (prefusion) residues X-X; lower sequence (post-fusion) residues Y-Y); Domain V (italics and bold, i.e., upper sequence (prefusion) residues X-X; lower sequence (post-fusion) residues Y-Y); MPR (underline only, i.e., upper sequence (prefusion) residues X-X; lower sequence (post-fusion) residues Y-Y); TM (italics, bold, and underlined, i.e., upper sequence (prefusion) residues X-X; lower sequence (post-fusion) residues Y-Y)). The upper and lower sequences are for the prefusion and postfusion structure models, respectively.

FIG. 4A-B—Comparison of the structures of gB in two conformations. The gB stabilized prefusion structure (FIG. 4A) and postfusion structure (FIG. 4B) are shown with one protomer colored to indicate the domains. (blue, green, yellow, orange, red, magenta, cyan for domains I, II, III, IV, V, MPR and TM respectively). The vertical black dashed line extending from the top of the prefusion structure represents residues missing from the model due to a less defined density map. The overall dimensions of the buildable ectodomain parts of the structure are indicated by the dashed line rectangles. The red arrows indicate the direction pointed by the C-termini of the central 3-helix bundle in domain III of each conformation. The 115 Å dimension on the prefusion structure (left) indicates the height of the modeled part of the ectodomain.

FIG. 5B: A close view of the electron density around the compound (grey transparent surface). Nearby amino acid residues are shown and domains are labeled. FIG. 5C: The interacting residues around the compound are shown. In both FIG. 5B and FIG. 5C, the asterisks indicate the domains or residues that are from an adjacent protomer.

FIG. 6A (prefusion) depicts a prefusion conformation; FIG. 6B (Extended intermediate) depicts an extended intermediate conformation; FIG. 6C (postfusion) depicts a postfusion conformation.

FIG. 8—Information from Research Collaboratory for Structural Bioinformatics Protein Data Bank (RCSB PDB) file: 5CXF, Crystal structure of the extracellular domain of glycoprotein B from Human Cytomegalovirus, from Human cytomegalovirus (strain AD169), deposited 2015-07-28; DOI: 10.2210/pdb5CXF/pdb.

Unit Cell:

| Length (Å) | Angle (°) |
|---|---|
| a = 92.183 | α = 90.00 |
| b = 133.930 | β = 90.00 |
| c = 295.376 | γ = 90.00 |

FIG. 9—Sequences of gB from clinical and laboratory-adapted HCMV strains (SEQ ID NO: 110-SEQ ID NO: 140). An amino acid sequence alignment of gB from clinical and laboratory-adapted HCMV strains may be found in S4 Fig., from Burke et al., "Crystal Structure of the Human Cytomegalovirus Glycoprotein B." PLoS Pathog. 2015 Oct. 20; 11(10):e1005227. According to Burke et alk. sixty HCMV gB sequences from clinical and laboratory-adapted strains, downloaded from NCBI's RefSeq data base, were aligned and analyzed using ClustalW2 and ESPript 3.x. Identical residues are shown as white text on red background, and similar residues are highlighted in yellow in S4 Fig. of Burke et al., "Crystal Structure of the Human Cytomegalovirus Glycoprotein B." PLoS Pathog. 2015 Oct. 20; 11(10):e1005227, said S4 Fig. is incorporated by reference in its entirety.

FIG. 10—Amino acid sequences for SEQ ID NOs: 1-43 and SEQ ID NOs: 47-106.

Figure 11:
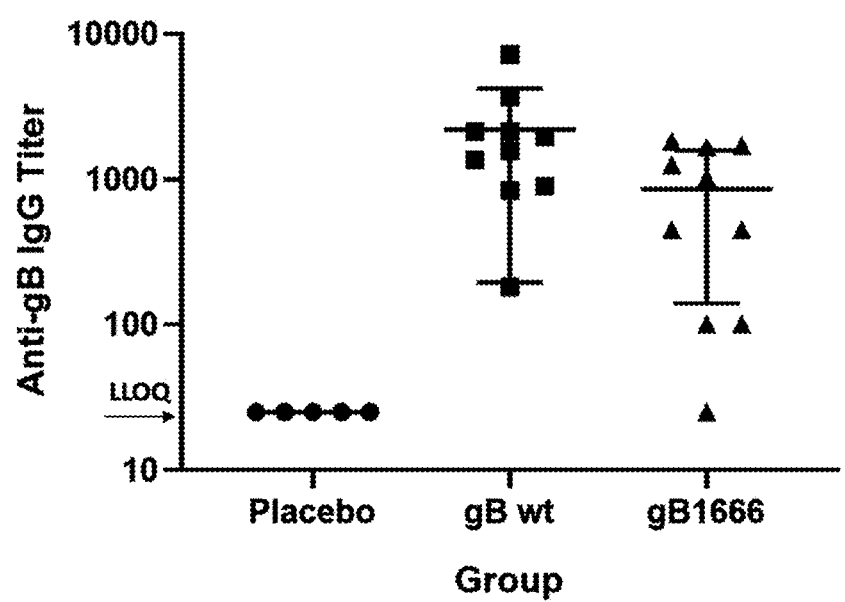

FIG. 11 Graph depicting 10 out of 10 mice immunized with wild type gB DNA, and 9 out of 10 mice immunized with gB1666 DNA generated detectable anti-gB IgG titers. Mean±SD, LLOQ=25).

SEQUENCE IDENTIFIERS

SEQ ID NO: 1 sets forth an amino acid sequence derived from a native HCMV gB (strain Towne).

SEQ ID NO: 2 sets forth the amino acid sequence of SEQ ID NO: 1, wherein the following mutations are included: Q98C, G271C.

SEQ ID NO: 3 sets forth the amino acid sequence of SEQ ID NO: 1, wherein the following mutations are included: Q98C, I653C.

SEQ ID NO: 4 sets forth the amino acid sequence of SEQ ID NO: 1, wherein the following mutations are included: G99C, A267C.

SEQ ID NO: 5 sets forth the amino acid sequence of SEQ ID NO: 1, wherein the following mutations are included: T100C, A267C.

SEQ ID NO: 6 sets forth the amino acid sequence of SEQ ID NO: 1, wherein the following mutations are included: T100C, S269C.

SEQ ID NO: 7 sets forth the amino acid sequence of SEQ ID NO: 1, wherein the following mutations are included: T100C, L651C.

SEQ ID NO: 8 sets forth the amino acid sequence of SEQ ID NO: 1, wherein the following mutations are included: D217C, F584C.

SEQ ID NO: 9 sets forth the amino acid sequence of SEQ ID NO: 1, wherein the following mutations are included: Y218C, A585C.

SEQ ID NO: 10 sets forth the amino acid sequence of SEQ ID NO: 1, wherein the following mutations are included: S219C, D654C.

SEQ ID NO: 11 sets forth the amino acid sequence of SEQ ID NO: 1, wherein the following mutations are included: N220C, D652C.

SEQ ID NO: 12 sets forth the amino acid sequence of SEQ ID NO: 1, wherein the following mutations are included: T221C, D652C.

SEQ ID NO: 13 sets forth the amino acid sequence of SEQ ID NO: 1, wherein the following mutations are included: W240C, G718C.

SEQ ID NO: 14 sets forth the amino acid sequence of SEQ ID NO: 1, wherein the following mutations are included: Y242C, K710C.

SEQ ID NO: 15 sets forth the amino acid sequence of SEQ ID NO: 1, wherein the following mutations are included: Y242C, D714C.

SEQ ID NO: 16 sets forth the amino acid sequence of SEQ ID NO: 1, wherein the following mutations are included: S269C, I653C.

SEQ ID NO: 17 sets forth the amino acid sequence of SEQ ID NO: 1, wherein the following mutations are included: G271C, P614C.

SEQ ID NO: 18 sets forth the amino acid sequence of SEQ ID NO: 1, wherein the following mutations are included: S367C, L499C.

SEQ ID NO: 19 sets forth the amino acid sequence of SEQ ID NO: 1, wherein the following mutations are included: T372C, W506C.

SEQ ID NO: 20 sets forth the amino acid sequence of SEQ ID NO: 1, wherein the following mutations are included: F541C, Q669C.

SEQ ID NO: 21 sets forth the amino acid sequence of SEQ ID NO: 1, wherein the following mutations are included: L548C, A650C.

SEQ ID NO: 22 sets forth the amino acid sequence of SEQ ID NO: 1, wherein the following mutations are included: A549C, I653C.

SEQ ID NO: 23 sets forth the amino acid sequence of SEQ ID NO: 1, wherein the following mutations are included: S550C, D652C.

SEQ ID NO: 24 sets forth the amino acid sequence of SEQ ID NO: 1, wherein the following mutations are included: G604C, F661C.

SEQ ID NO: 25 sets forth the amino acid sequence of SEQ ID NO: 1, wherein the following mutations are included: N605C, E665C.

SEQ ID NO: 26 sets forth the amino acid sequence of SEQ ID NO: 1, wherein the following mutations are included: R607C, S675C.

SEQ ID NO: 27 sets forth the amino acid sequence of SEQ ID NO: 1, wherein the following mutations are included: T608C, D679C.

SEQ ID NO: 28 sets forth the amino acid sequence of SEQ ID NO: 1, wherein the following mutations are included: E609C, F678C.

SEQ ID NO: 29 sets forth the amino acid sequence of SEQ ID NO: 1, wherein the following mutations are included: R673C, S674C.

SEQ ID NO: 30 sets forth the amino acid sequence of SEQ ID NO: 1, wherein the following mutations are included: N676C, V677C.

SEQ ID NO: 31 sets forth the amino acid sequence of SEQ ID NO: 1, wherein the following mutations are included: L680C, E681C.

SEQ ID NO: 32 sets forth the amino acid sequence of SEQ ID NO: 1, wherein the following mutations are included: I683C, M684C.

SEQ ID NO: 33 sets forth the amino acid sequence of SEQ ID NO: 1, wherein the following mutations are included: F687C, N688C.

SEQ ID NO: 34 sets forth the amino acid sequence of SEQ ID NO: 1, wherein the following mutations are included: Y690C, K691C.

SEQ ID NO: 35 sets forth the amino acid sequence of SEQ ID NO: 1, wherein the following mutations are included: K695C, K724C.

SEQ ID NO: 36 sets forth the amino acid sequence of SEQ ID NO: 1, wherein the following mutations are included: T746C, F747C.

SEQ ID NO: 37 sets forth the amino acid sequence of SEQ ID NO: 1, wherein the following mutations are included: K749C, N750C.

SEQ ID NO: 38 sets forth the amino acid sequence of SEQ ID NO: 1, wherein the following mutation is included: K670L.

SEQ ID NO: 39 sets forth the amino acid sequence of SEQ ID NO: 1, wherein the following mutation is included: K670F.

SEQ ID NO: 40 sets forth the amino acid sequence of SEQ ID NO: 1, wherein the following mutation is included: R673L.

SEQ ID NO: 41 sets forth the amino acid sequence of SEQ ID NO: 1, wherein the following mutation is included: R673F.

SEQ ID NO: 42 sets forth the amino acid sequence of SEQ ID NO: 1, wherein the following mutation is included: K691L.

SEQ ID NO: 43 sets forth the amino acid sequence of SEQ ID NO: 1, wherein the following mutation is included: K691F.

SEQ ID NO: 44 sets forth the amino acid sequence for a native HCMV gB (AD169; PDB: 5CXF) that folds into a postfusion conformation when expressed.

SEQ ID NO: 45 sets forth the amino acid sequence for an HCMV gB variant (gB705) that folds into a postfusion conformation when expressed.

SEQ ID NO: 46 sets forth the amino acid sequence for a native HCMV gB (Merlin strain) that folds into a postfusion conformation when expressed.

SEQ ID NO: 47 sets forth the amino acid of SEQ ID NO: 1, wherein the following mutations are included: M96C and D660C.

SEQ ID NO: 48 sets forth the amino acid of SEQ ID NO: 1, wherein the following mutations are included: Q98C and N658C.

SEQ ID NO: 49 sets forth the amino acid of SEQ ID NO: 1, wherein the following mutations are included: T100C and R258C.

SEQ ID NO: 50 sets forth the amino acid of SEQ ID NO: 1, wherein the following mutations are included: T100C and L656C.

SEQ ID NO: 51 sets forth the amino acid of SEQ ID NO: 1, wherein the following mutations are included: T100C and N658C.
SEQ ID NO: 52 sets forth the amino acid of SEQ ID NO: 1, wherein the following mutations are included: I117C and T406C.
SEQ ID NO: 53 sets forth the amino acid of SEQ ID NO: 1, wherein the following mutations are included: I117C and S407C.
SEQ ID NO: 54 sets forth the amino acid of SEQ ID NO: 1, wherein the following mutations are included: Y153C and L712C.
SEQ ID NO: 55 sets forth the amino acid of SEQ ID NO: 1, wherein the following mutations are included: L162C and M716C.
SEQ ID NO: 56 sets forth the amino acid of SEQ ID NO: 1, wherein the following mutations are included: D217C and S587C.
SEQ ID NO: 57 sets forth the amino acid of SEQ ID NO: 1, wherein the following mutations are included: D217C and Y589C.
SEQ ID NO: 58 sets forth the amino acid of SEQ ID NO: 1, wherein the following mutations are included: S219C and F584C.
SEQ ID NO: 59 sets forth the amino acid of SEQ ID NO: 1, wherein the following mutations are included: S219C and A585C.
SEQ ID NO: 60 sets forth the amino acid of SEQ ID NO: 1, wherein the following mutations are included: S219C and N586C.
SEQ ID NO: 61 sets forth the amino acid of SEQ ID NO: 1, wherein the following mutations are included: N220C and T659C.
SEQ ID NO: 62 sets forth the amino acid of SEQ ID NO: 1, wherein the following mutations are included: S223C and T659C.
SEQ ID NO: 63 sets forth the amino acid of SEQ ID NO: 1, wherein the following mutations are included: W240C and A732A.
SEQ ID NO: 64 sets forth the amino acid of SEQ ID NO: 1, wherein the following mutations are included: W240C and G735C.
SEQ ID NO: 65 sets forth the amino acid of SEQ ID NO: 1, wherein the following mutations are included: Y242C and V728C.
SEQ ID NO: 66 sets forth the amino acid of SEQ ID NO: 1, wherein the following mutations are included: Y242C and G731C.
SEQ ID NO: 67 sets forth the amino acid of SEQ ID NO: 1, wherein the following mutations are included: R258C and L656C.
SEQ ID NO: 68 sets forth the amino acid of SEQ ID NO: 1, wherein the following mutations are included: S269C and L656C.
SEQ ID NO: 69 sets forth the amino acid of SEQ ID NO: 1, wherein the following mutations are included: S269C and N658C.
SEQ ID NO: 70 sets forth the amino acid of SEQ ID NO: 1, wherein the following mutations are included: D272C and P614C.
SEQ ID NO: 71 sets forth the amino acid of SEQ ID NO: 1, wherein the following mutations are included: V273C and V629C.
SEQ ID NO: 72 sets forth the amino acid of SEQ ID NO: 1, wherein the following mutations are included: W349C and A650C.
SEQ ID NO: 73 sets forth the amino acid of SEQ ID NO: 1, wherein the following mutations are included: S367C and A500C.
SEQ ID NO: 74 sets forth the amino acid of SEQ ID NO: 1, wherein the following mutations are included: S367C and A503C.
SEQ ID NO: 75 sets forth the amino acid of SEQ ID NO: 1, wherein the following mutations are included: K370C and Q501C.
SEQ ID NO: 76 sets forth the amino acid of SEQ ID NO: 1, wherein the following mutations are included: K522C and I683C.
SEQ ID NO: 77 sets forth the amino acid of SEQ ID NO: 1, wherein the following mutations are included: I523C and I683C.
SEQ ID NO: 78 sets forth the amino acid of SEQ ID NO: 1, wherein the following mutations are included: I523C and M684C.
SEQ ID NO: 79 sets forth the amino acid of SEQ ID NO: 1, wherein the following mutations are included: N524C and M684C.
SEQ ID NO: 80 sets forth the amino acid of SEQ ID NO: 1, wherein the following mutations are included: P525C and E681C.
SEQ ID NO: 81 sets forth the amino acid of SEQ ID NO: 1, wherein the following mutations are included: R540C and L680C.
SEQ ID NO: 82 sets forth the amino acid of SEQ ID NO: 1, wherein the following mutations are included: F541C and L680C.
SEQ ID NO: 83 sets forth the amino acid of SEQ ID NO: 1, wherein the following mutations are included: L548C and P655C.
SEQ ID NO: 84 sets forth the amino acid of SEQ ID NO: 1, wherein the following mutations are included: A549C and N658C.
SEQ ID NO: 85 sets forth the amino acid of SEQ ID NO: 1, wherein the following mutations are included: S550C and P655C.
SEQ ID NO: 86 sets forth the amino acid of SEQ ID NO: 1, wherein the following mutations are included: S550C and E657C.
SEQ ID NO: 87 sets forth the amino acid of SEQ ID NO: 1, wherein the following mutations are included: Q591C and S668C.
SEQ ID NO: 88 sets forth the amino acid of SEQ ID NO: 1, wherein the following mutations are included: L603C and Y667C.
SEQ ID NO: 89 sets forth the amino acid of SEQ ID NO: 1, wherein the following mutations are included: G604C and L672C.
SEQ ID NO: 90 sets forth the amino acid of SEQ ID NO: 1, wherein the following mutations are included: R607C and N688C.
SEQ ID NO: 91 sets forth the amino acid of SEQ ID NO: 1, wherein the following mutations are included: T608C and Q692C.
SEQ ID NO: 92 sets forth the amino acid of SEQ ID NO: 1, wherein the following mutations are included: E609C and K691C.
SEQ ID NO: 93 sets forth the amino acid of SEQ ID NO: 1, wherein the following mutations are included: E610C and S674C.
SEQ ID NO: 94 sets forth the amino acid of SEQ ID NO: 1, wherein the following mutations are included: E610C and S675C.

SEQ ID NO: 95 sets forth the amino acid of SEQ ID NO: 1, wherein the following mutations are included: Q612C and V663C.
SEQ ID NO: 96 sets forth the amino acid of SEQ ID NO: 1, wherein the following mutations are included: V737C and F755C.
SEQ ID NO: 97 sets forth the amino acid of SEQ ID NO: 1, wherein the following mutations are included: V741C and A754C.
SEQ ID NO: 98 sets forth the amino acid of SEQ ID NO: 1, wherein the following mutations are included: V741C and F755C.
SEQ ID NO: 99 sets forth the amino acid of SEQ ID NO: 1, wherein the following mutation is included: D679S.
SEQ ID NO: 100 sets forth the amino acid of SEQ ID NO: 1, wherein the following mutation is included: D679N.
SEQ ID NO: 101 sets forth the amino acid of SEQ ID NO: 1, wherein the following mutation is included: E682S.
SEQ ID NO: 102 sets forth the amino acid of SEQ ID NO: 1, wherein the following mutation is included: E682Q.
SEQ ID NO: 103 sets forth the amino acid of SEQ ID NO: 1, wherein the following mutation is included: E686S.
SEQ ID NO: 104 sets forth the amino acid of SEQ ID NO: 1, wherein the following mutation is included: E686Q.
SEQ ID NO: 105 sets forth the amino acid of SEQ ID NO: 1, wherein the following mutation is included: N118P.
SEQ ID NO: 106 sets forth the amino acid of SEQ ID NO: 1, wherein the following mutation is included: D646P.
SEQ ID NO: 107 sets forth the amino acid sequence for >5CXF:A|PDBID|CHAIN|SEQUENCE, from FIG. 8.
SEQ ID NO: 108 sets forth the amino acid sequence for >5CXF:B|PDBID|CHAIN|SEQUENCE, from FIG. 8.
SEQ ID NO: 109 sets forth the amino acid sequence for >5CXF:C|PDBID|CHAIN|SEQUENCE, from FIG. 8.
SEQ ID NO: 110 sets forth the amino acid sequence for a gB polypeptide from HAN13 gi|242345614|gb|GQ221973.1|:81988-84705 Human herpesvirus 5 strain HAN13, complete genome reverse complement, referenced in the description for FIG. 9.
SEQ ID NOs: 111-140 sets forth the amino acid sequence for a gB polypeptide from the respective strain disclosed in FIG. 9.
SEQ ID NO: 141-SEQ ID NO: 210 sets forth a polynucleotide sequence encoding a polypolypeptide derived from HCMV.
For example, SEQ ID NO: 153 is an exemplary nucleic acid sequence encoding gH. SEQ ID NO: 153 is an exemplary nucleic acid sequence encoding gL. SEQ ID NO: 153 is an exemplary nucleic acid sequence encoding UL128. SEQ ID NO: 153 is an exemplary nucleic acid sequence encoding UL128. SEQ ID NO: 156 is an exemplary nucleic acid sequence encoding UL130. SEQ ID NO: 210 is an exemplary nucleic acid sequence encoding UL131. SEQ ID NO: 152 is an exemplary nucleic acid sequence encoding gB.
SEQ ID NO: 158 is an exemplary nucleic acid sequence encoding pp65.
SEQ ID NO: 211-SEQ ID NO: 223 set forth an amino acid sequence for a polypeptide derived from HCMV.
For example, SEQ ID NO: 211 is an exemplary amino acid sequence encoding gH. SEQ ID NO: 213 is an exemplary amino acid sequence for UL128. SEQ ID NO: 214 is an exemplary amino acid sequence for UL130. SEQ ID NO: 215 is an exemplary amino acid sequence for UL131. SEQ ID NO: 216 is an exemplary amino acid sequence for gB. SEQ ID NO: 217 is an exemplary amino acid sequence for pp65.
SEQ ID NO: 224-SEQ ID NO: 254 set forth a polynucleotide sequence encoding a polypolypeptide derived from HCMV.

DETAILED DESCRIPTION

As described herein, the inventors elucidated a three-dimensional structure of a HCMV glycoprotein B (gB) polypeptide in a conformation that differs from the postfusion conformation and which we refer to as a prefusion conformation. Mutations to stabilize the polypeptide in a prefusion conformation were also discovered. The structures may be used to generate HCMV neutralizing antibody responses greater than those achieved with prior HCMV gB-based immunogens. The polypeptides described herein, and the nucleic acids that encode the polypeptides, may be used, for example, as potential immunogens in a vaccine against HCMV and as diagnostic tools, among other uses.

The inventors further discovered mutations that can be introduced into a cytomegalovirus (CMV) gB polypeptide, which can, among other things, greatly facilitate the production and subsequent purification of a gB antigen stabilized in the prefusion conformation; significantly improve the efficiency of production of a gB polypeptide in the prefusion conformation; alter the antigenicity of a gB polypeptide, as compared to the wild-type gB polypeptide; facilitate a focused immune response to prefusion gB; and reduce and/or eliminate steric occlusion of neutralizing epitopes of gB.

Native HCMV gB

Native HCMV gB is synthesized as a 906 or 907 amino acid polypeptide (depending upon the strain of CMV) that undergoes extensive posttranslational modification, including glycosylation at N- and O-linked sites and cleavage by ubiquitous cellular endoproteases into amino- and carboxy-terminal fragments. The N- and C-terminal fragments of gB, gp116 and gp55, respectively, are covalently connected by disulfide bonds, and the mature, glycosylated gB assumes a trimeric configuration. The gB polypeptide contains a large ectodomain (which is cleaved into gp116 and the ectodomain of gp55), a transmembrane domain (TM), and the intraviral (or cytoplasmic) domain (cytodomain).

Native HCMV gBs from various strains are known. For example, at least sixty HCMV gB sequences from clinical and laboratory-adapted strains are available from NCBI's RefSeq database. See also FIG. 9.

Accordingly, the term "CMV gB" polypeptide or "HCMV gB" polypeptide as used herein is to be understood as the native HCMV gB polypeptide from any human HCMV strain (not limited to the Towne strain). The actual residue position number may need to be adjusted for gBs from other human CMV strains depending on the actual sequence alignment.

HCMV gB is encoded by the UL55 gene of HCMV genome. It is an envelope glycoprotein that mediates the fusion of the HCMV viral membrane with a host cell membrane. The protein undergoes a series of conformational changes from a prefusion to a postfusion form. The crystal structure of gB in its postfusion form is available (PDB accession code 5CXF), but the prefusion conformation has not been determined to date.

Conformations

A HCMV gB postfusion conformation refers to a structural conformation adopted by HCMV gB subsequent to the fusion of the virus envelope with the host cellular membrane. The native HCMV gB may also assume the postfusion conformation outside the context of a fusion event, for example, under stress conditions such as exposure to heat, extraction from a membrane, expression as an ectodomain or storage. More specifically, the gB postfusion conformation is described, for example, in Burke et al., Crystal Structure of the Human Cytomegalovirus Glycoprotein B. PLoS Pathog. 2015 Oct. 20; 11(10): e1005227. See also, Research Collaboratory for Structural Bioinformatics Protein Data Bank (RCSB PDB): 5CXF, Crystal structure of the extracellular domain of glycoprotein B from Human Cytomegalovirus, from Human cytomegalovirus (strain AD169), deposited 2015-07-28; DOI: 10.2210/pdb5CXF/pdb; and FIG. 9. A sequence of a protein that when expressed, can fold into a postfusion conformation, is provided as SEQ ID NO: 44. Another example of a protein that when expressed folds into a postfusion conformation is provided as SEQ ID NO: 45. The postfusion conformation is about 165 Å tall and 65 Å wide.

As used herein, a "prefusion conformation" refers to a structural conformation adopted by the polypeptide that differs from the HCMV gB postfusion conformation at least in terms of molecular dimensions or three-dimensional coordinates. The prefusion conformation refers to a structural conformation adopted by HCMV gB prior to triggering of the fusogenic event that leads to transition of gB to the postfusion conformation. Isolating HCMV gB in a stable prefusion conformation may be useful in informing and directing development of improved vaccines and immunogenic compositions to address the important public health problem of cytomegalovirus infections. In some embodiments, a prefusion conformation includes a conformation that can bind to a prefusion-specific antibody, In some embodiments, a prefusion conformation includes a conformation that is characterized by coordinates set forth in Table 1, which is incorporated by reference herein in its entirety. In some embodiments, the polypeptide is characterized by structure coordinates comprising a root mean square deviation (RMSD) of conserved residue backbone atoms when superimposed on backbone atoms described by structural coordinates of Table 1. In some embodiments, a polypeptide having a HCMV gB prefusion conformation refers to a polypeptide that includes a trimeric helix bundle, centered on the three-fold axis of the trimer and comprising residues L479 to K522 of each protomer, wherein the direction of the bundle from N-terminal to C-terminal along the three-fold axis (shown by the arrows in FIG. 4) is towards the point on the three-fold axis intersected by the plane defined by residue W240 of each protomer, which is in a fusion loop near the tip of each Domain I of the trimer. In some embodiments, the helix bundle comprises the residues between L479 and K522, according to the numbering of SEQ ID NO: 1.

Polypeptides of the Invention

The present invention relates to polypeptides that include amino acid mutations relative to the amino acid sequence of the corresponding wild-type HCMV gB. The amino acid mutations include amino acid substitutions, deletions, or additions relative to a wild-type HCMV gB. Accordingly, the polypeptides are mutants of wild-type HCMV gBs.

In some embodiments, the polypeptides possess certain beneficial characteristics, such as being immunogenic. In some embodiments, the polypeptides possess increased immunogenic properties or improved stability in the prefusion conformation, as compared to the corresponding wild-type HCMV gB. Stability refers to the degree to which a transition of the HCMV gB conformation from prefusion to postfusion is hindered or prevented. In still other embodiments, the present disclosure provides polypeptides that display one or more introduced mutations as described herein, which may also result in improved stability in the prefusion conformation. The introduced amino acid mutations in the HCMV gB include amino acid substitutions, deletions, or additions. In some embodiments, the only mutations in the amino acid sequences of the mutants are amino acid substitutions relative to a wild-type HCMV gB.

Several modes of stabilizing the polypeptide conformation include amino acid substitutions that introduce disulfide bonds, introduce electrostatic mutations, fill cavities, alter the packing of residues, introduce N-linked glycosylation sites, and combinations thereof, as compared to a native HCMV gB.

In one aspect, the invention relates to a polypeptide that exhibits a conformation that is not the postfusion conformation. That is, the polypeptide exhibits a prefusion conformation as described above and does not exhibit a postfusion conformation. See, for example, the prefusion conformation illustrated in FIG. 3, left panel, as compared to the postfusion conformation illustrated in FIG. 3, right panel; FIG. 4, left panel, as compared to the postfusion conformation illustrated in FIG. 4, right panel; and FIG. 6A, as compared to the postfusion conformation illustrated in FIG. 6C. In some embodiments, the polypeptide is characterized by structure coordinates comprising a root mean square deviation (RMSD) of conserved residue backbone atoms when superimposed on backbone atoms described by structural coordinates of Table 1.

In some embodiments, the polypeptides are isolated, i.e., separated from HCMV gB polypeptides having a postfusion conformation. Thus, the polypeptide may be, for example, at least 80% isolated, at least 90%, 95%, 98%, 99%, or even 99.9% isolated from HCMV gB polypeptides in a postfusion conformation. In one aspect, the invention relates to a polypeptide that specifically binds to an HCMV gB prefusion-specific antibody.

It will be understood that a homogeneous population of polypeptides in a particular conformation can include variations (such as polypeptide modification variations, e.g., glycosylation state), that do not alter the conformational state of the polypeptide. In several embodiments, the population of polypeptides remains homogeneous over time. For example, in some embodiments, the polypeptide, when dissolved in aqueous solution, forms a population of polypeptides stabilized in the prefusion conformation for at least 12 hours, such as at least 24 hours, at least 48 hours, at least one week, at least two weeks, or more.

Without being bound by theory, the polypeptides disclosed herein are believed to facilitate a stabilized prefusion conformation of an HCMV gB polypeptide. The polypeptides include at least one mutation as compared to a corresponding native HCMV gB polypeptide. A person of ordinary skill in the art will appreciate that the polypeptides are useful to elicit immune responses in mammals to CMV.

The native HCMV gB is conserved among the HCMV entry glycoproteins and is required for entry into all cell types. In view of the substantial conservation of HCMV gB sequences, the amino acid positions amongst different native HCMV gB sequences may be compared to identify corresponding HCMV gB amino acid positions among different HCMV strains. Thus, the conservation of native HCMV gB sequences across strains allows use of a reference HCMV gB sequence for comparison of amino acids at particular positions in the HCMV gB polypeptide. Accordingly, unless expressly indicated otherwise, the polypeptide amino acid positions provided herein refer to the reference sequence of the HCMV gB polypeptide set forth in SEQ ID NO: 1.

However, it should be noted that different native HCMV gB sequences may have different numbering systems from SEQ ID NO: 1, for example, there may be additional amino acid residues added or removed as compared to SEQ ID NO: 1 in a native HCMV gB sequence derived from a strain other than Towne. As such, it is to be understood that when specific amino acid residues are referred to by their number, the description is not limited to only amino acids located at precisely that numbered position when counting from the beginning of a given amino acid sequence, but rather that the equivalent or corresponding amino acid residue in any and all HCMV gB sequences is intended even if that residue is not at the same precise numbered position, for example if the HCMV sequence is shorter or longer than SEQ ID NO: 1, or has insertions or deletions as compared to SEQ ID NO: 1.

1. Cysteine (C) Substitutions

In some embodiments, the polypeptide includes cysteine substitutions that are introduced, as compared to a native HCMV gB. In some embodiments, the polypeptide includes any one of 1, 2, 3, 4, 5, 6, 7, 8, 9, or 10 cysteine substitutions. Without being bound by theory or mechanism, the cysteine substitutions described herein are believed to facilitate stability of the polypeptide in a conformation that is not the HCMV gB postfusion conformation. The introduced cysteine substitutions may be introduced by protein engineering, for example, by including one or more substituted cysteine residues that form a disulfide bond. In several embodiments, the amino acid positions of the cysteines are within a sufficiently close distance for formation of a disulfide bond in the prefusion, and not postfusion, conformation of the HCMV gB.

The cysteine residues that form a disulfide bond can be introduced into native HCMV gB sequence by two or more amino acid substitutions. For example, in some embodiments, two cysteine residues are introduced into a native HCMV gB sequence to form a disulfide bond.

In some embodiments, the polypeptide includes a recombinant HCMV gB stabilized in a prefusion conformation by a disulfide bond between cysteines that are introduced into a pair of amino acid positions that are close to each other in the prefusion conformation and more distant in the postfusion conformation.

Exemplary cysteine substitutions as compared to a native HCMV gB include any mutation selected from Table 2, the numbering of which based on the numbering of SEQ ID NO: 1.

TABLE 2

Exemplary cysteine pairs for disulfide bond stabilization

| Row | (i) Mutant ID | (ii) HCMV gB residue pairs for cysteine substitution, according to the numbering of SEQ ID NO: 1 | (iii) Substitutions corresponding to SEQ ID NO: 1 | (iv) Exemplary sequence that includes the mutations is set forth in: |
|---|---|---|---|---|
| 1 | gB-001; pSB1582 | 98 and 271 | Q98C, G271C | SEQ ID NO: 2 |
| 2 | gB-002 | 98 and 653 | Q98C, I653C | SEQ ID NO: 3 |
| 3 | gB-003; pSB01579 | 99 and 267 | G99C, A267C | SEQ ID NO: 4 |
| 4 | gB-004; pSB01580 | 100 and 267 | T100C, A267C | SEQ ID NO: 5 |
| 5 | gB-005; pSB01581 | 100 and 269 | T100C, S269C | SEQ ID NO: 6 |
| 6 | gB-006 | 100 and 651 | T100C, L651C | SEQ ID NO: 7 |
| 7 | gB-007 | 217 and 584 | D217C, F584C | SEQ ID NO: 8 |
| 8 | gB-008 | 218 and 585 | Y218C, A585C | SEQ ID NO: 9 |
| 9 | gB-009 | 219 and 654 | S219C, D654C | SEQ ID NO: 10 |
| 10 | gB-010 | 220 and 652 | N220C, D652C | SEQ ID NO: 11 |
| 11 | gB-011 | 221 and 652 | T221C, D652C | SEQ ID NO: 12 |
| 12 | gB-012 | 240 and 718 | W240C, G718C | SEQ ID NO: 13 |
| 13 | gB-013 | 242 and 710 | Y242C, K710C | SEQ ID NO: 14 |
| 14 | gB-014 | 242 and 714 | Y242C, D714C | SEQ ID NO: 15 |
| 15 | gB-015 | 269 and 653 | S269C, I653C | SEQ ID NO: 16 |
| 16 | gB-016 | 271 and 614 | G271C, P614C | SEQ ID NO: 17 |
| 17 | gB-017 | 367 and 499 | S367C, L499C | SEQ ID NO: 18 |
| 18 | gB-018 | 372 and 506 | T372C, W506C | SEQ ID NO: 19 |
| 19 | gB-019 | 541 and 669 | F541C, Q669C | SEQ ID NO: 20 |
| 20 | gB-020 | 548 and 650 | L548C, A650C | SEQ ID NO: 21 |
| 21 | gB-021 | 549 and 653 | A549C, I653C | SEQ ID NO: 22 |
| 22 | gB-022 | 550 and 652 | S550C, D652C | SEQ ID NO: 23 |
| 23 | gB-023 | 604 and 661 | G604C, F661C | SEQ ID NO: 24 |
| 24 | gB-024 | 605 and 665 | N605C, E665C | SEQ ID NO: 25 |
| 25 | gB-025 | 607 and 675 | R607C, S675C | SEQ ID NO: 26 |
| 26 | gB-026 | 608 and 679 | T608C, D679C | SEQ ID NO: 27 |
| 27 | gB-027 | 609 and 678 | E609C, F678C | SEQ ID NO: 28 |
| 28 | gB-028 | 673 and 674 | R673C, S674C | SEQ ID NO: 29 |
| 29 | gB-029 | 676 and 677 | N676C, V677C | SEQ ID NO: 30 |
| 30 | gB-030 | 680 and 681 | L680C, E681C | SEQ ID NO: 31 |
| 31 | gB-031 | 683 and 684 | I683C, M684C | SEQ ID NO: 32 |
| 32 | gB-032 | 687 and 688 | F687C, N688C | SEQ ID NO: 33 |
| 33 | gB-033 | 690 and 691 | Y690C, K691C | SEQ ID NO: 34 |
| 34 | gB-034 | 695 and 724 | K695C, K724C | SEQ ID NO: 35 |
| 35 | gB-035 | 746 and 747 | T746C, F747C | SEQ ID NO: 36 |
| 36 | gB-036 | 749 and 750 | K749C, N750C | SEQ ID NO: 37 |
| 37 | gB-043; pSB01656 | 96 and 660 | M96C, D660C | SEQ ID NO: 47 |
| 38 | gB-044; pSB01657 | 98 and 658 | Q98C, N658C | SEQ ID NO: 48 |
| 39 | gB-045; pSB01658 | 100 and 258 | T100C, R258C | SEQ ID NO: 49 |
| 40 | gB-046; pSB01659 | 100 and 656 | T100C, L656C | SEQ ID NO: 50 |
| 41 | gB-047; pSB01660 | 100 and 658 | T100C, N658C | SEQ ID NO: 51 |
| 42 | gB-048; pSB01661 | 117 and 406 | I117C, T406C | SEQ ID NO: 52 |
| 43 | gB-049; pSB01662 | 117 and 407 | I117C, S407C | SEQ ID NO: 53 |
| 44 | gB-050; pSB01663 | 153 and 712 | Y153C, L712C | SEQ ID NO: 54 |
| 45 | gB-051; pSB01664 | 162 and 716 | L162C, M716C | SEQ ID NO: 55 |
| 46 | gB-052; pSB01665 | 217 and 587 | D217C, S587C | SEQ ID NO: 56 |
| 47 | gB-053; pSB01666 | 217 and 589 | D217C, Y589C | SEQ ID NO: 57 |
| 48 | gB-054; pSB01667 | 219 and 584 | S219C, F584C | SEQ ID NO: 58 |
| 49 | gB-055; pSB01668 | 219 and 585 | S219C, A585C | SEQ ID NO: 59 |
| 50 | gB-056; pSB01669 | 219 and 586 | S219C, N586C | SEQ ID NO: 60 |
| 51 | gB-057; pSB01670 | 220 and 659 | N220C, T659C | SEQ ID NO: 61 |
| 52 | gB-058; pSB01671 | 223 and 659 | S223C, T659C | SEQ ID NO: 62 |
| 53 | gB-059; pSB01672 | 240 and 732 | W240C, A732C | SEQ ID NO: 63 |
| 54 | gB-060; pSB01673 | 240 and 735 | W240C, G735C | SEQ ID NO: 64 |
| 55 | gB-061; pSB01674 | 242 and 728 | Y242C, V728C | SEQ ID NO: 65 |

TABLE 2-continued

Exemplary cysteine pairs for disulfide bond stabilization

| Row | (i) Mutant ID | (ii) HCMV gB residue pairs for cysteine substitution, according to the numbering of SEQ ID NO: 1 | (iii) Substitutions corresponding to SEQ ID NO: 1 | (iv) Exemplary sequence that includes the mutations is set forth in: |
|---|---|---|---|---|
| 56 | gB-062; pSB01675 | 242 and 731 | Y242C, G731C | SEQ ID NO: 66 |
| 57 | gB-063 | 258 and 656 | R258C, L656C | SEQ ID NO: 67 |
| 58 | gB-064 | 269 and 656 | S269C, L656C | SEQ ID NO: 68 |
| 59 | gB-065 | 269 and 658 | S269C, N658C | SEQ ID NO: 69 |
| 60 | gB-066; pSB01679 | 272 and 614 | D272C, P614C | SEQ ID NO: 70 |
| 61 | gB-067; pSB01680 | 273 and 629 | V273C, V629C | SEQ ID NO: 71 |
| 62 | gB-068 | 349 and 650 | W349C, A650C | SEQ ID NO: 72 |
| 63 | gB-069; pSB01682 | 367 and 500 | S367C, A500C | SEQ ID NO: 73 |
| 64 | gB-070; pSB01683 | 367 and 503 | S367C, A503C | SEQ ID NO: 74 |
| 65 | gB-071; pSB01684 | 370 and 501 | K370C, Q501C | SEQ ID NO: 75 |
| 66 | gB-072; pSB01685 | 522 and 683 | K522C, I683C | SEQ ID NO: 76 |
| 67 | gB-073; pSB01686 | 523 and 683 | I523C, I683C | SEQ ID NO: 77 |
| 68 | gB-074; pSB01687 | 523 and 684 | I523C, M684C | SEQ ID NO: 78 |
| 69 | gB-075 | 524 and 684 | N524C, M684C | SEQ ID NO: 79 |
| 70 | gB-076 | 525 and 681 | P525C, E681C | SEQ ID NO: 80 |
| 71 | gB-077 | 540 and 680 | R540C, L680C | SEQ ID NO: 81 |
| 72 | gB-078 | 541 and 680 | F541C, L680C | SEQ ID NO: 82 |
| 73 | gB-079 | 548 and 655 | L548C, P655C | SEQ ID NO: 83 |
| 74 | gB-080 | 549 and 658 | A549C, N658C | SEQ ID NO: 84 |
| 75 | gB-081 | 550 and 655 | S550C, P655C | SEQ ID NO: 85 |
| 76 | gB-082 | 550 and 657 | S550C, E657C | SEQ ID NO: 86 |
| 77 | gB-083 | 591 and 668 | Q591C, S668C | SEQ ID NO: 87 |
| 78 | gB-084; pSB01697 | 603 and 667 | L603C, Y667C | SEQ ID NO: 88 |
| 79 | gB-085; pSB01698 | 604 and 672 | G604C, L672C | SEQ ID NO: 89 |
| 80 | gB-086; pSB01699 | 607 and 688 | R607C, N688C | SEQ ID NO: 90 |
| 81 | gB-087; pSB01700 | 608 and 692 | T608C, Q692C | SEQ ID NO: 91 |
| 82 | gB-088; pSB01701 | 609 and 691 | E609C, K691C | SEQ ID NO: 92 |
| 83 | gB-089; pSB01702 | 610 and 674 | E610C, S674C | SEQ ID NO: 93 |
| 84 | gB-090; pSB01703 | 610 and 675 | E610C, S675C | SEQ ID NO: 94 |
| 85 | gB-091; pSB01704 | 612 and 663 | Q612C, V663C | SEQ ID NO: 95 |
| 86 | gB-092; pSB01705 | 737 and 755 | V737C, F755C | SEQ ID NO: 96 |
| 87 | gB-093; pSB01706 | 741 and 754 | V741C, A754C | SEQ ID NO: 97 |
| 88 | gB-094; pSB01707 | 741 and 755 | V741C, F755C | SEQ ID NO: 98 |

In some embodiments, the polypeptide includes one or more (such as 2, 3, 4, 5, 6, 7, 8, 9 or 10) cysteine substitutions at any one of the positions listed in one or more of rows 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, or 36 of column (ii) of Table 2, wherein the resulting polypeptide does not exhibit an HCMV postfusion conformation.

In some embodiments, the polypeptide includes one or more (such as 2, 3, 4, 5, 6, 7, 8, 9 or 10) cysteine substitutions at any one of the positions listed in one or more of rows 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, or 88 of column (ii) of Table 2, wherein the resulting polypeptide does not exhibit an HCMV postfusion conformation.

In a preferred embodiment, the polypeptide includes cysteine substitutions at positions 98 and 653 (listed in row 2, column (ii) of Table 2) according to the numbering of SEQ ID NO: 1, relative to the amino acid sequence of the wild-type HCMV gB. In another preferred embodiment, the polypeptide includes cysteine substitutions at positions 100 and 269 (listed in row 5, column (ii) of Table 2) according to the numbering of SEQ ID NO: 1, relative to the amino acid sequence of the wild-type HCMV gB. In a further preferred embodiment, the polypeptide includes cysteine substitutions at positions 217 and 584 (listed in row 7, column (ii) of Table 2) according to the numbering of SEQ ID NO: 1, relative to the amino acid sequence of the wild-type HCMV gB. In a preferred embodiment, the polypeptide includes cysteine substitutions at positions 242 and 710 (listed in row 13, column (ii) of Table 2) according to the numbering of SEQ ID NO: 1, relative to the amino acid sequence of the wild-type HCMV gB. In another preferred embodiment, the polypeptide includes cysteine substitutions at positions 242 and 714 (listed in row 14, column (ii) of Table 2) according to the numbering of SEQ ID NO: 1, relative to the amino acid sequence of the wild-type HCMV gB. In a further preferred embodiment, the polypeptide includes cysteine substitutions at positions 367 and 499 (listed in row 17, column (ii) of Table 2) according to the numbering of SEQ ID NO: 1, relative to the amino acid sequence of the wild-type HCMV gB. In a preferred embodiment, the polypeptide includes cysteine substitutions at positions 372 and 506 (listed in row 18, column (ii) of Table 2) according to the numbering of SEQ ID NO: 1, relative to the amino acid sequence of the wild-type HCMV gB. In another preferred embodiment, the polypeptide includes cysteine substitutions at positions 550 and 652 (listed in row 22, column (ii) of Table 2) according to the numbering of SEQ ID NO: 1, relative to the amino acid sequence of the wild-type HCMV gB. In a further preferred embodiment, the polypeptide includes cysteine substitutions at positions 608 and 679 (listed in row 26, column (ii) of Table 2) according to the numbering of SEQ ID NO: 1, relative to the amino acid sequence of the wild-type HCMV gB. In a preferred embodiment, the polypeptide includes cysteine substitutions at positions 695 and 724 (listed in row 34, column (ii) of Table 2) according to the numbering of SEQ ID NO: 1, relative to the amino acid sequence of the wild-type HCMV gB.

In some embodiments, the polypeptide includes one or more (such as 2, 3, 4, 5, 6, 7, 8, 9 or 10) disulfide bonds between pairs of cysteine residues substituted at any one of the pairs of positions listed in one or more of rows 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, and 88 of column (ii) of Table 2.

In a preferred embodiment, the polypeptide includes a disulfide bond between a pair of cysteine residues substituted at positions 98 and 653 (listed in row 2, column (ii) of Table 2) according to the numbering of SEQ ID NO: 1, relative to the amino acid sequence of the wild-type HCMV gB. In another preferred embodiment, the polypeptide includes a disulfide bond between a pair of cysteine residues substituted at positions 100 and 269 (listed in row 5, column (ii) of Table 2) according to the numbering of SEQ ID NO: 1, relative to the amino acid sequence of the wild-type HCMV gB. In a further preferred embodiment, the polypeptide includes a disulfide bond between a pair of cysteine residues substituted at positions 217 and 584 (listed in row 7, column (ii) of Table 2) according to the numbering of SEQ ID NO: 1, relative to the amino acid sequence of the wild-type HCMV gB. In a preferred embodiment, the polypeptide includes a disulfide bond between a pair of cysteine residues substituted at positions 242 and 710 (listed in row 13, column (ii) of Table 2) according to the numbering of SEQ ID NO: 1, relative to the amino acid sequence of the wild-type HCMV gB. In another preferred embodiment, the polypeptide includes a disulfide bond between a pair of cysteine residues substituted at positions 242 and 714 (listed in row 14, column (ii) of Table 2) according to the numbering of SEQ ID NO: 1, relative to the amino acid sequence of the wild-type HCMV gB. In a further preferred embodiment, the polypeptide includes a disulfide bond between a pair of cysteine residues substituted at positions 367 and 499 (listed in row 17, column (ii) of Table 2) according to the numbering of SEQ ID NO: 1, relative to the amino acid sequence of the wild-type HCMV gB. In a preferred embodiment, the polypeptide includes a disulfide bond between a pair of cysteine residues substituted at positions 372 and 506 (listed in row 18, column (ii) of Table 2) according to the numbering of SEQ ID NO: 1, relative to the amino acid sequence of the wild-type HCMV gB. In another preferred embodiment, the polypeptide includes a disulfide bond between a pair of cysteine residues substituted at positions 550 and 652 (listed in row 22, column (ii) of Table 2) according to the numbering of SEQ ID NO: 1, relative to the amino acid sequence of the wild-type HCMV gB. In a further preferred embodiment, the polypeptide includes a disulfide bond between a pair of cysteine residues substituted at positions 608 and 679 (listed in row 26, column (ii) of Table 2) according to the numbering of SEQ ID NO: 1, relative to the amino acid sequence of the wild-type HCMV gB. In a preferred embodiment, the polypeptide includes a disulfide bond between a pair of cysteine residues substituted at positions 695 and 724 (listed in row 34, column (ii) of Table 2) according to the numbering of SEQ ID NO: 1, relative to the amino acid sequence of the wild-type HCMV gB.

In further embodiments, the polypeptide includes one or more (such as 2, 3, 4, 5, 6, 7, 8, 9 or 10) disulfide bonds between pairs of cysteine residues that are introduced by cysteine amino acid substitutions at any one of the pairs of positions listed in one or more of rows 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, or 36 of column (iii) of Table 2, wherein the polypeptide does not exhibit an HCMV postfusion conformation.

In further embodiments, the polypeptide includes one or more (such as 2, 3, 4, 5, 6, 7, 8, 9 or 10) disulfide bonds between pairs of cysteine residues that are introduced by cysteine amino acid substitutions at any one of the pairs of positions listed in one or more of rows 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69 70, 71 72, 73, 74, 75, 76, 77, 78, 79, 80, 81, 82, 83, 84, 85, 86, 87, or 88 of column (iii) of Table 2, wherein the polypeptide does not exhibit an HCMV postfusion conformation.

In a preferred embodiment, the polypeptide includes cysteine substitutions at Q98C and 1653C (listed in row 2, column (iii) of Table 2) according to the numbering of SEQ ID NO: 1, relative to the amino acid sequence of the wild-type HCMV gB. In another preferred embodiment, the polypeptide includes cysteine substitutions at T100C and S269C (listed in row 5, column (iii) of Table 2) according to the numbering of SEQ ID NO: 1, relative to the amino acid sequence of the wild-type HCMV gB. In a further preferred embodiment, the polypeptide includes cysteine substitutions at D217 and F584C (listed in row 7, column (iii) of Table 2) according to the numbering of SEQ ID NO: 1, relative to the amino acid sequence of the wild-type HCMV gB. In a preferred embodiment, the polypeptide includes cysteine substitutions at Y242C and K710C (listed in row 13, column (iii) of Table 2) according to the numbering of SEQ ID NO: 1, relative to the amino acid sequence of the wild-type HCMV gB. In another preferred embodiment, the polypeptide includes cysteine substitutions at Y242C and D714C (listed in row 14, column (iii) of Table 2) according to the numbering of SEQ ID NO: 1, relative to the amino acid sequence of the wild-type HCMV gB. In a further preferred embodiment, the polypeptide includes cysteine substitutions at S367C and L499C (listed in row 17, column (iii) of Table 2) according to the numbering of SEQ ID NO: 1, relative to the amino acid sequence of the wild-type HCMV gB. In a preferred embodiment, the polypeptide includes cysteine substitutions at T372C and W506C (listed in row 18, column (iii) of Table 2) according to the numbering of SEQ ID NO: 1, relative to the amino acid sequence of the wild-type HCMV gB. In another preferred embodiment, the polypeptide includes cysteine substitutions at S550C and D652C (listed in row 22, column (iii) of Table 2) according to the numbering of SEQ ID NO: 1, relative to the amino acid sequence of the wild-type HCMV gB. In a further preferred embodiment, the polypeptide includes cysteine substitutions at T608C and D679C (listed in row 26, column (iii) of Table 2) according to the numbering of SEQ ID NO: 1, relative to the amino acid sequence of the wild-type HCMV gB. In a preferred embodiment, the polypeptide includes cysteine substitutions at K695C and K724C (listed in row 34, column (iii) of Table 2) according to the numbering of SEQ ID NO: 1, relative to the amino acid sequence of the wild-type HCMV gB.

In a preferred embodiment, the polypeptide includes a disulfide bond between a pair of cysteine residues substituted at positions 96 and 660 according to the numbering of SEQ ID NO: 1, relative to the amino acid sequence of the wild-type HCMV gB. In another preferred embodiment, the polypeptide includes a disulfide bond between a pair of cysteine residues substituted at positions 98 and 658 according to the numbering of SEQ ID NO: 1, relative to the amino acid sequence of the wild-type HCMV gB. In a further preferred embodiment, the polypeptide includes a disulfide bond between a pair of cysteine residues substituted at positions 100 and 258 according to the numbering of SEQ ID NO: 1, relative to the amino acid sequence of the wild-type HCMV gB. In a preferred embodiment, the polypeptide includes a disulfide bond between a pair of cysteine residues substituted at positions 100 and 656 according to the numbering of SEQ ID NO: 1, relative to the amino acid sequence of the wild-type HCMV gB. In another preferred embodiment, the polypeptide includes a disulfide bond between a pair of cysteine residues substituted at positions 100 and 658 according to the numbering of SEQ ID NO: 1, relative to the amino acid sequence of the wild-type HCMV gB. In a further preferred embodiment, the polypeptide includes a disulfide bond between a pair of cysteine residues substituted at positions 117 and 406 according to the numbering of SEQ ID NO: 1, relative to the amino acid sequence of the wild-type HCMV gB. In a preferred embodiment, the polypeptide includes a disulfide bond between a pair of cysteine residues substituted at positions 117 and 407 according to the numbering of SEQ ID NO: 1, relative to the amino acid sequence of the wild-type HCMV gB. In a preferred embodiment, the polypeptide includes a disulfide bond between a pair of cysteine residues substituted at positions 153 and 712 according to the numbering of SEQ ID NO: 1, relative to the amino acid sequence of the wild-type HCMV gB. In a preferred embodiment, the polypeptide includes a disulfide bond between a pair of cysteine residues substituted at positions 162 and 716 according to the numbering of SEQ ID NO: 1, relative to the amino acid sequence of the wild-type HCMV gB. In a preferred embodiment, the polypeptide includes a disulfide bond between a pair of cysteine residues substituted at positions 217 and 587 according to the numbering of SEQ ID NO: 1, relative to the amino acid sequence of the wild-type HCMV gB. In a preferred embodiment, the polypeptide includes a disulfide bond between a pair of cysteine residues substituted at positions 217 and 589 according to the numbering of SEQ ID NO: 1, relative to the amino acid sequence of the wild-type HCMV gB. In a preferred embodiment, the polypeptide includes a disulfide bond between a pair of cysteine residues substituted at positions 219 and 584 according to the numbering of SEQ ID NO: 1, relative to the amino acid sequence of the wild-type HCMV gB. In a preferred embodiment, the polypeptide includes a disulfide bond between a pair of cysteine residues substituted at positions 219 and 585 according to the numbering of SEQ ID NO: 1, relative to the amino acid sequence of the wild-type HCMV gB. In a preferred embodiment, the polypeptide includes a disulfide bond between a pair of cysteine residues substituted at positions 219 and 586 according to the numbering of SEQ ID NO: 1, relative to the amino acid sequence of the wild-type HCMV gB. In a preferred embodiment, the polypeptide includes a disulfide bond between a pair of cysteine residues substituted at positions 220 and 659 according to the numbering of SEQ ID NO: 1, relative to the amino acid sequence of the wild-type HCMV gB. In a preferred embodiment, the polypeptide includes a disulfide bond between a pair of cysteine residues substituted at positions 223 and 659 according to the numbering of SEQ ID NO: 1, relative to the amino acid sequence of the wild-type HCMV gB. In a preferred embodiment, the polypeptide includes a disulfide bond between a pair of cysteine residues substituted at positions 240 and 732 according to the numbering of SEQ ID NO: 1, relative to the amino acid sequence of the wild-type HCMV gB. In a preferred embodiment, the polypeptide includes a disulfide bond between a pair of cysteine residues substituted at positions 240 and 735 according to the numbering of SEQ ID NO: 1, relative to the amino acid sequence of the wild-type HCMV gB. In a preferred embodiment, the polypeptide includes a disulfide bond between a pair of cysteine residues substituted at positions 242 and 728 according to the numbering of SEQ ID NO: 1, relative to the amino acid sequence of the wild-type HCMV gB. In a preferred embodiment, the polypeptide includes a disulfide bond between a pair of cysteine residues substituted at positions 242 and 731 according to the numbering of SEQ ID NO: 1, relative to the amino acid sequence of the wild-type HCMV gB. In a preferred embodiment, the polypeptide includes a disulfide bond between a pair of cysteine residues substituted at positions 258 and 656 according to the numbering of SEQ ID NO: 1, relative to the amino acid sequence of the wild-type HCMV gB. In a preferred embodiment, the polypeptide includes a disulfide bond between a pair of cysteine residues substituted at positions 269 and 656 according to the numbering of SEQ ID NO: 1, relative to the amino acid sequence of the wild-type HCMV gB. In a preferred embodiment, the polypeptide includes a disulfide bond between a pair of cysteine residues substituted at positions 269 and 658 according to the numbering of SEQ ID NO: 1, relative to the amino acid sequence of the wild-type HCMV gB. In a preferred embodiment, the polypeptide includes a disulfide bond between a pair of cysteine residues substituted at positions 272 and 614 according to the numbering of SEQ ID NO: 1, relative to the amino acid sequence of the wild-type HCMV gB. In a preferred embodiment, the polypeptide includes a disulfide bond between a pair of cysteine residues substituted at positions 273 and 629 according to the numbering of SEQ ID NO: 1, relative to the amino acid sequence of the wild-type HCMV gB. In a preferred embodiment, the polypeptide includes a disulfide bond between a pair of cysteine residues substituted at positions 349 and 650 according to the numbering of SEQ ID NO: 1, relative to the amino acid sequence of the wild-type HCMV gB. In a preferred embodiment, the polypeptide includes a disulfide bond between a pair of cysteine residues substituted at positions 367 and 500 according to the numbering of SEQ ID NO: 1, relative to the amino acid sequence of the wild-type HCMV gB. In a preferred embodiment, the polypeptide includes a disulfide bond between a pair of cysteine residues substituted at positions 367 and 503 according to the numbering of SEQ ID NO: 1, relative to the amino acid sequence of the wild-type HCMV gB. In a preferred embodiment, the polypeptide includes a disulfide bond between a pair of cysteine residues substituted at positions 370 and 501 according to the numbering of SEQ ID NO: 1, relative to the amino acid sequence of the wild-type HCMV gB. In a preferred embodiment, the polypeptide includes a disulfide bond between a pair of cysteine residues substituted at positions 522 and 683 according to the numbering of SEQ ID NO: 1, relative to the amino acid sequence of the wild-type HCMV gB. In a preferred embodiment, the polypeptide includes a disulfide bond between a pair of cysteine residues substituted at positions 523 and 683 according to the numbering of SEQ ID NO: 1, relative to the amino acid sequence of the wild-type HCMV gB. In a preferred embodiment, the polypeptide includes a disulfide bond between a pair of cysteine residues substituted at positions 523 and 684 according to the numbering of SEQ ID NO: 1, relative to the amino acid sequence of the wild-type HCMV gB. In a preferred embodiment, the polypeptide includes a disulfide bond between a pair of cysteine residues substituted at positions 524 and 684 according to the numbering of SEQ ID NO: 1, relative to the amino acid sequence of the wild-type HCMV gB. In a preferred embodiment, the polypeptide includes a disulfide bond between a pair of cysteine residues substituted at positions 525 and 681 according to the numbering of SEQ ID NO: 1, relative to the amino acid sequence of the wild-type HCMV gB. In a preferred embodiment, the polypeptide includes a disulfide bond between a pair of cysteine residues substituted at positions 540 and 680 according to the numbering of SEQ ID NO: 1, relative to the amino acid sequence of the wild-type HCMV gB. In a preferred embodiment, the polypeptide includes a disulfide bond between a pair of cysteine residues substituted at positions 541 and 680 according to the numbering of SEQ ID NO: 1, relative to the amino acid sequence of the wild-type HCMV gB. In a preferred embodiment, the polypeptide includes a disulfide bond between a pair of cysteine residues substituted at positions 548 and 655 according to the numbering of SEQ ID NO: 1, relative to the amino acid sequence of the wild-type HCMV gB. In a preferred embodiment, the polypeptide includes a disulfide bond between a pair of cysteine residues substituted at positions 549 and 658 according to the numbering of SEQ ID NO: 1, relative to the amino acid sequence of the wild-type HCMV gB. In a preferred embodiment, the polypeptide includes a disulfide bond between a pair of cysteine residues substituted at positions 550 and 655 according to the numbering of SEQ ID NO: 1, relative to the amino acid sequence of the wild-type HCMV gB. In a preferred embodiment, the polypeptide includes a disulfide bond between a pair of cysteine residues substituted at positions 550 and 657 according to the numbering of SEQ ID NO: 1, relative to the amino acid sequence of the wild-type HCMV gB. In a preferred embodiment, the polypeptide includes a disulfide bond between a pair of cysteine residues substituted at positions 591 and 668 according to the numbering of SEQ ID NO: 1, relative to the amino acid sequence of the wild-type HCMV gB. In a preferred embodiment, the polypeptide includes a disulfide bond between a pair of cysteine residues substituted at positions 603 and 667 according to the numbering of SEQ ID NO: 1, relative to the amino acid sequence of the wild-type HCMV gB. In a preferred embodiment, the polypeptide includes a disulfide bond between a pair of cysteine residues substituted at positions 604 and 672 according to the numbering of SEQ ID NO: 1, relative to the amino acid sequence of the wild-type HCMV gB. In a preferred embodiment, the polypeptide includes a disulfide bond between a pair of cysteine residues substituted at positions 607 and 688 according to the numbering of SEQ ID NO: 1, relative to the amino acid sequence of the wild-type HCMV gB. In a preferred embodiment, the polypeptide includes a disulfide bond between a pair of cysteine residues substituted at positions 608 and 692 according to the numbering of SEQ ID NO: 1, relative to the amino acid sequence of the wild-type HCMV gB. In a preferred embodiment, the polypeptide includes a disulfide bond between a pair of cysteine residues substituted at positions 609 and 691 according to the numbering of SEQ ID NO: 1, relative to the amino acid sequence of the wild-type HCMV gB. In a preferred embodiment, the polypeptide includes a disulfide bond between a pair of cysteine residues substituted at positions 610 and 674 according to the numbering of SEQ ID NO: 1, relative to the amino acid sequence of the wild-type HCMV gB. In a preferred embodiment, the polypeptide includes a disulfide bond between a pair of cysteine residues substituted at positions 610 and 675 according to the numbering of SEQ ID NO: 1, relative to the amino acid sequence of the wild-type HCMV gB. In a preferred embodiment, the polypeptide includes a disulfide bond between a pair of cysteine residues substituted at positions 612 and 663 according to the numbering of SEQ ID NO: 1, relative to the amino acid sequence of the wild-type HCMV gB. In a preferred embodiment, the polypeptide includes a disulfide bond between a pair of cysteine residues substituted at positions 737 and 755 according to the numbering of SEQ ID NO: 1, relative to the amino acid sequence of the wild-type HCMV gB. In a preferred embodiment, the polypeptide includes a disulfide bond between a pair of cysteine residues substituted at positions 741 and 754 according to the numbering of SEQ ID NO: 1, relative to the amino acid sequence of the wild-type HCMV gB. In a preferred embodiment, the polypeptide includes a disulfide bond between a pair of cysteine residues substituted at positions 741 and 755 according to the numbering of SEQ ID NO: 1, relative to the amino acid sequence of the wild-type HCMV gB.

In some embodiments, the polypeptide includes a combination of two or more of the disulfide bonds between cysteine residues listed in Table 2.

In some embodiments, the polypeptide includes an amino acid sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to any sequence selected from: SEQ ID NO: 2; SEQ ID NO: 3; SEQ ID NO: 4; SEQ ID NO: 5; SEQ ID NO: 6; SEQ ID NO: 7; SEQ ID NO: 8; SEQ ID NO: 9; SEQ ID NO: 10; SEQ ID NO: 11; SEQ ID NO: 12; SEQ ID NO: 13; SEQ ID NO: 14; SEQ ID NO: 15; SEQ ID NO: 16; SEQ ID NO: 17; SEQ ID NO: 18; SEQ ID NO: 19; SEQ ID NO: 20; SEQ ID NO: 21; SEQ ID NO: 22; SEQ ID NO: 23; SEQ ID NO: 24; SEQ ID NO: 25; SEQ ID NO: 26; SEQ ID NO: 27; SEQ ID NO: 28; SEQ ID NO: 29; SEQ ID NO: 30; SEQ ID NO: 31; SEQ ID NO: 32; SEQ ID NO: 33; SEQ ID NO: 34; SEQ ID NO: 35; SEQ ID NO: 36; and SEQ ID NO: 37.

In some embodiments, the polypeptide includes an amino acid sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to any sequence selected from: SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, and SEQ ID NO: 98.

In some embodiments, the polypeptide includes an amino acid sequence having at least 80%, 81%, 82%, 83%, 84%, 85%, 86%, 87%, 88%, 89%, 90%, 91%, 92%, 93%, 94%, 95%, 96%, 97%, 98%, preferably 99%, or 100% identity to any sequence selected from SEQ ID NO: 56, SEQ ID NO: 57, SEQ ID NO: 58, and SEQ ID NO: 60.

In some embodiments, the polypeptide includes an amino acid sequence having at least 80%, 81%, 82%, 83%, 84%, 85%, 86%, 87%, 88%, 89%, 90%, 91%, 92%, 93%, 94%, 95%, 96%, 97%, 98%, preferably 99%, or 100% identity to any sequence selected from SEQ ID NO: 51, SEQ ID NO: 73, SEQ ID NO: 70, and SEQ ID NO: 78

In some embodiments, the composition preferably does not include a polypeptide having the sequence set forth in any one of SEQ ID NO: 59, SEQ ID NO: 75, SEQ ID NO: 76, SEQ ID NO: 71, SEQ ID NO: 52, SEQ ID NO: 96, and SEQ ID NO: 50.

In additional embodiments, the polypeptide includes the amino acid sequence as set forth in any one of the SEQ ID NOs listed in column (iv) of Table 2. That is, an exemplary polypeptide includes a polypeptide having the amino acid sequence selected from any one of: SEQ ID NO: 2; SEQ ID NO: 3; SEQ ID NO: 4; SEQ ID NO: 5; SEQ ID NO: 6; SEQ ID NO: 7; SEQ ID NO: 8; SEQ ID NO: 9; SEQ ID NO: 10;

SEQ ID NO: 11; SEQ ID NO: 12; SEQ ID NO: 13; SEQ ID NO: 14; SEQ ID NO: 15; SEQ ID NO: 16; SEQ ID NO: 17; SEQ ID NO: 18; SEQ ID NO: 19; SEQ ID NO: 20; SEQ ID NO: 21; SEQ ID NO: 22; SEQ ID NO: 23; SEQ ID NO: 24; SEQ ID NO: 25; SEQ ID NO: 26; SEQ ID NO: 27; SEQ ID NO: 28; SEQ ID NO: 29; SEQ ID NO: 30; SEQ ID NO: 31; SEQ ID NO: 32; SEQ ID NO: 33; SEQ ID NO: 34; SEQ ID NO: 35; SEQ ID NO: 36; and SEQ ID NO: 37. In some embodiments, the polypeptide has the amino acid sequence selected from any one of SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, and SEQ ID NO: 98.

In a preferred embodiment, the polypeptide includes the amino acid sequence as set forth in any one of SEQ ID NO: 3; SEQ ID NO: 6; SEQ ID NO: 8; SEQ ID NO: 14; SEQ ID NO: 15; SEQ ID NO: 18; SEQ ID NO: 19; SEQ ID NO: 23; SEQ ID NO: 27; and SEQ ID NO: 35.

In some embodiments, amino acids can be inserted (or deleted) from the native HCMV gB sequence to adjust the alignment of residues in the polypeptide structure, such that particular residue pairs are within a sufficiently close distance to form a disulfide bond in the prefusion, but not postfusion, conformation. In several such embodiments, the polypeptide includes a disulfide bond between cysteine residues located at any of the pairs of positions listed in one or more of rows 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, or 88 of column (ii) of Table 2, in addition to including at least one amino acid insertion.

In some embodiments, the polypeptide includes a phenylalanine substitution as compared to a native HCMV gB. In some embodiments, the polypeptide includes a leucine substitution as compared to a native HCMV gB. In some embodiments, the polypeptide may be stabilized by amino acid mutations (such as, for example, phenylalanine (F) and leucine (L) substitutions) that decrease ionic repulsion between resides that are proximate to each other in the folded structure of the polypeptide, as compared to a HCMV gB polypeptide in postfusion conformation. In some embodiments, the polypeptide may be stabilized by amino acid mutations that increase ionic attraction between residues that are proximate to each other in the folded structure of the polypeptide, as compared to a HCMV gB in postfusion conformation.

Exemplary mutations include any mutation selected from Table 3, according to the numbering of SEQ ID NO: 1 as compared to a native HCMV gB:

TABLE 3

Exemplary Phenylalanine (F) and Leucine (L) Substitutions

| Row | (i) Mutant ID | (ii) Mutated residue position, according to the numbering of SEQ ID NO: 1 | (iii) Substitutions corresponding to SEQ ID NO: 1 | (iv) Exemplary sequence that includes the mutations is set forth in: |
| --- | --- | --- | --- | --- |
| 1 | gB-037 | 670 | K670L | SEQ ID NO: 38 |
| 2 | gB-038 | 670 | K670F | SEQ ID NO: 39 |
| 3 | gB-039 | 673 | R673L | SEQ ID NO: 40 |
| 4 | gB-040 | 673 | R673F | SEQ ID NO: 41 |
| 5 | gB-041 | 691 | K691L | SEQ ID NO: 42 |
| 6 | gB-042 | 691 | K691F | SEQ ID NO: 43 |

TABLE 4

Further exemplary substitutions

| Row | (i) Mutant ID | (ii) Mutated residue position, according to the numbering of SEQ ID NO: 1 | (iii) Substitutions corresponding to SEQ ID NO: 1 | (iv) Exemplary sequence that includes the mutations is set forth in: |
| --- | --- | --- | --- | --- |
| 1 | gB-095 | 679 | D679S | SEQ ID NO: 99 |
| 2 | gB-096 | 679 | D679N | SEQ ID NO: 100 |
| 3 | gB-097 | 682 | E682S | SEQ ID NO: 101 |
| 4 | gB-098 | 682 | E682Q | SEQ ID NO: 102 |
| 5 | gB-099 | 686 | E686S | SEQ ID NO: 103 |
| 6 | gB-100 | 686 | E686Q | SEQ ID NO: 104 |
| 7 | gB-101 | 118 | N118P | SEQ ID NO: 105 |
| 8 | gB-102 | 646 | D646P | SEQ ID NO: 106 |

In some embodiments, the polypeptide includes one or more (such as 2, 3, 4, 5, 6, 7, 8, 9 or 10) residues substituted at any one of the positions listed in one or more of rows 1, 2, 3, 4, 5, or 6 of column (ii) of Table 3, wherein the polypeptide does not exhibit an HCMV postfusion conformation.

In some embodiments, the polypeptide includes one or more (such as 2, 3, 4, 5, 6, 7, 8, 9 or 10) residues substituted at any one of the positions listed in one or more of rows 1, 2, 3, 4, 5, 6, 7, and 8 of column (ii) of Table 4, wherein the polypeptide does not exhibit an HCMV postfusion conformation.

In some embodiments, the polypeptide includes a mutation at position 670 (listed in rows 1 and 2, column (ii) of Table 3) according to the numbering of SEQ ID NO: 1. In some embodiments, the polypeptide includes a mutation at position 673 (listed in rows 3 and 4, column (ii) of Table 3) according to the numbering of SEQ ID NO: 1. In some embodiments, the polypeptide includes a mutation at position 691 (listed in rows 5 and 6, column (ii) of Table 3) according to the numbering of SEQ ID NO: 1.

In some embodiments, the polypeptide includes a mutation at position 670 according to the numbering of SEQ ID NO: 1. In some embodiments, the polypeptide includes a mutation at position 682 according to the numbering of SEQ ID NO: 1. In some embodiments, the polypeptide includes a mutation at position 686 according to the numbering of SEQ ID NO: 1. In some embodiments, the polypeptide includes a mutation at position 118 according to the numbering of SEQ ID NO: 1. In some embodiments, the polypeptide includes a mutation at position 646 according to the numbering of SEQ ID NO:

In further embodiments, the polypeptide includes an electrostatic mutation that is introduced by substitutions at any one of the positions listed in one or more of rows 1, 2, 3, 4, 5, or 6 of column (iii) of Table 3, wherein the polypeptide does not exhibit an HCMV postfusion conformation.

In a preferred embodiment, the polypeptide includes a substitution K670L (listed in row 1, column (iii) of Table 3) according to the numbering of SEQ ID NO: 1. In another preferred embodiment, the polypeptide includes a substitution K670F (listed in row 2, column (iii) of Table 3) according to the numbering of SEQ ID NO: 1. In a further preferred embodiment, the polypeptide includes a substitution R673L (listed in row 3, column (iii) of Table 3) according to the numbering of SEQ ID NO: 1. In a preferred embodiment, the polypeptide includes a substitution R673F (listed in row 4, column (iii) of Table 3) according to the numbering of SEQ ID NO: 1. In another preferred embodiment, the polypeptide includes a substitution K691L (listed in row 5, column (iii) of Table 3) according to the numbering of SEQ ID NO: 1. In a further preferred embodiment, the polypeptide includes a substitution K691F (listed in row 6, column (iii) of Table 3) according to the numbering of SEQ ID NO: 1.

In some embodiments, the polypeptide includes a combination of two or more of the phenylalanine (F) and leucine (L) substitutions listed in Table 3.

In a preferred embodiment, the polypeptide includes a substitution D679S according to the numbering of SEQ ID NO: 1. In another preferred embodiment, the polypeptide includes a substitution D679N according to the numbering of SEQ ID NO: 1. In another preferred embodiment, the polypeptide includes a substitution E682S according to the numbering of SEQ ID NO: 1. In another preferred embodiment, the polypeptide includes a substitution E682Q according to the numbering of SEQ ID NO: 1. In another preferred embodiment, the polypeptide includes a substitution E686S according to the numbering of SEQ ID NO: 1. In another preferred embodiment, the polypeptide includes a substitution E686Q according to the numbering of SEQ ID NO: 1. In another preferred embodiment, the polypeptide includes a substitution N118P according to the numbering of SEQ ID NO: 1. In another preferred embodiment, the polypeptide includes a substitution D646P according to the numbering of SEQ ID NO: 1.

In some embodiments, the polypeptide includes a combination of two or more of the phenylalanine (F) and leucine (L) substitutions listed in Table 4. In some embodiments, the polypeptide includes an amino acid sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to any sequence selected from: SEQ ID NO: 38; SEQ ID NO: 39; SEQ ID NO: 40; SEQ ID NO: 41; SEQ ID NO: 42; and SEQ ID NO: 43.

In some embodiments, the polypeptide includes an amino acid sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to any sequence selected from: SEQ ID NO: 99; SEQ ID NO: 100, SEQ ID NO: 102, SEQ ID NO: 103, SEQ ID NO: 104, SEQ ID NO: 105, and SEQ ID NO: 106.

In additional embodiments, the polypeptide includes the amino acid sequence as set forth in any one of the SEQ ID NOs listed in column (iv) of Table 3. That is, an exemplary polypeptide includes a polypeptide having the amino acid sequence selected from any one of: SEQ ID NO: 38; SEQ ID NO: 39; SEQ ID NO: 40; SEQ ID NO: 41; SEQ ID NO: 42; and SEQ ID NO: 43. In some embodiments, the polypeptide has the amino acid sequence selected from any one of: SEQ ID NO: 99; SEQ ID NO: 100, SEQ ID NO: 102, SEQ ID NO: 103, SEQ ID NO: 104, SEQ ID NO: 105, and SEQ ID NO: 106.

In some embodiments, amino acids can be inserted (or deleted) from the native HCMV gB sequence to adjust the alignment of residues in the polypeptide structure, such that particular residue pairs are within a sufficiently close distance to form a desired electrostatic interaction in the prefusion, but not postfusion, conformation. In several such embodiments, the polypeptide includes a desired electrostatic interaction at any of the positions listed in one or more of rows 1, 2, 3, 4, 5, or 6 of column (ii) of Table 3, wherein the polypeptide does not exhibit an HCMV postfusion conformation.

2. Further Embodiments of the Polypeptide

In some embodiments, the polypeptide does not include a mutation at any one of the following amino acid positions: 280, 281, 283, 284, 285, 286, 290, 292, 295, 297, 298, 299, or any combinations thereof, according to the numbering of reference sequence SEQ ID NO: 46. In some exemplary embodiments, the polypeptide does not include a substitution of any one of the following residues, according to the numbering of reference sequence SEQ ID NO: 46: Y280; N281; T283; N284; R285; N286; F290; E292; N293; F297; F298; I299; F298; and any combinations thereof. Without being bound by theory or mechanism, residues important for neutralizing antibodies may include Y280/N284 and Y280/N293/D295. Accordingly, in a preferred embodiment, the polypeptide does not include mutations at Y280, N293, N284, and D295, as compared to reference sequence SEQ ID NO: 46.

In some embodiments, the polypeptide does not include a mutation at any one of the following amino acid positions: R562, P577, S587, Y588, G592, G595, L601/H605, C610, L612, P613, Y625, Y627, F632, and K633, and any combinations thereof, according to the numbering of reference sequence SEQ ID NO: 44. In some embodiments, the polypeptide does not include any one of the following amino acid mutations: R562C, P577L, S587L, Y588C, G592S, G595D, L601P/H605N, C610Y, L612F, P613Y, Y625C, Y627C, F632L, and K633T, or any combinations thereof, according to the numbering of reference sequence SEQ ID NO: 44. Without being bound by theory or mechanism, P577 and Y627 are believed to be located next to each other within the domain IV core while C610 participates in a conserved disulfide bond. Thus, all three residues may help maintain the position of domain IV in the prefusion structure and, therefore, the stability of entire antigenic site AD-1. Moreover, without being bound by theory or mechanism, F632 and G595 are believed to be exposed on the surface of the prefusion form of gB. Accordingly, in a preferred embodiment, the polypeptide does not include a mutation at P577, Y627, C610, F632, and G595, or any combinations thereof, according to the numbering of reference sequence SEQ ID NO: 44.

3. Cavity Filling Mutations

In still other embodiments, the polypeptide includes amino acid mutations that are one or more cavity filling mutations. Examples of amino acids that may be replaced with the goal of cavity filling include small aliphatic (e.g. Gly, Ala, and Val) or small polar amino acids (e.g. Ser and Thr) and amino acids that are buried in the pre-fusion conformation, but exposed to solvent in the post-fusion conformation. Examples of the replacement amino acids include large aliphatic amino acids (Ile, Leu and Met) or large aromatic amino acids (His, Phe, Tyr and Trp).

4. Combination of Mutations

In another aspect, the present invention relates to a polypeptide that includes a combination of two or more different types of mutations selected from engineered disulfide bond mutations, cavity filling mutations, and electrostatic mutations, each as described herein above. In some embodiments, the polypeptide includes at least one disulfide bond mutation and at least electrostatic mutation. More specifically, in some embodiments, the polypeptide includes at least one cysteine substitution and at least one phenylalanine substitution. In some embodiments, the polypeptide includes at least one cysteine substitution and at least one leucine substitution.

In some further embodiments, the polypeptide includes at least one mutation selected from any one of the mutations in Table 2 and at least one mutation selected from any one of the mutations in Table 3. In some further embodiments, the polypeptide includes at least one mutation selected from any one of the mutations in Table 2 and at least one mutation selected from any one of the mutations in Table 4. In some further embodiments, the polypeptide includes at least one mutation selected from any one of the mutations in Table 3 and at least one mutation selected from any one of the mutations in Table 4.

Preparation of the Polypeptide

The polypeptides described herein may be prepared by routine methods known in the art, such as by expression in a recombinant host system using a suitable vector. Suitable recombinant host cells include, for example, insect cells, mammalian cells, avian cells, bacteria, and yeast cells. Examples of suitable insect cells include, for example, Sf9 cells, Sf21 cells, Tn5 cells, Schneider S2 cells, and HIGH FIVE cells (a clonal isolate derived from the parental Trichoplusia ni BTI-TN-5B1-4 cell line). Examples of suitable mammalian cells include Chinese hamster ovary (CHO) cells, human embryonic kidney cells (HEK293 or Expi 293 cells, typically transformed by sheared adenovirus type 5 DNA), NIH-3T3 cells, 293-T cells, Vero cells, and HeLa cells. Suitable avian cells include, for example, chicken embryonic stem cells (e.g., EBx.RTM. cells), chicken embryonic fibroblasts, chicken embryonic germ cells, quail fibroblasts (e.g. ELL-O), and duck cells. Suitable insect cell expression systems, such as baculovirus-vectored systems, are known to those of skill in the art. Materials and methods for baculovirus/insect cell expression systems are commercially available in kit form from. Avian cell expression systems are also known to those of skill in the art. Similarly, bacterial and mammalian cell expression systems are also known in the art.

A number of suitable vectors for expression of recombinant proteins in insect or mammalian cells are well-known and conventional in the art. Suitable vectors can contain a number of components, including, but not limited to one or more of the following: an origin of replication; a selectable marker gene; one or more expression control elements, such as a transcriptional control element (e.g., a promoter, an enhancer, a terminator), and/or one or more translation signals; and a signal sequence or leader sequence for targeting to the secretory pathway in a selected host cell (e.g., of mammalian origin or from a heterologous mammalian or non-mammalian species). For example, for expression in insect cells a suitable baculovirus expression vector, such as PFASTBAC, is used to produce recombinant baculovirus particles. The baculovirus particles are amplified and used to infect insect cells to express recombinant protein. For expression in mammalian cells, a vector that will drive expression of the construct in the desired mammalian host cell (e.g., Chinese hamster ovary cells) is used.

The polypeptide can be purified using any suitable methods. For example, methods for purifying a polypeptide by immunoaffinity chromatography are known in the art. Suitable methods for purifying desired polypeptides including precipitation and various types of chromatography, such as hydrophobic interaction, ion exchange, affinity, chelating and size exclusion are known in the art. Suitable purification schemes can be created using two or more of these or other suitable methods. If desired, the polypeptide may include a "tag" that facilitates purification, such as an epitope tag or a histidine tag. Such tagged polypeptides can be purified, for example from conditioned media, by chelating chromatography or affinity chromatography.

Nucleic Acids Encoding Polypeptides

In another aspect, the invention relates to nucleic acid molecules that encode a polypeptide described herein. These nucleic acid molecules include DNA, cDNA, and RNA sequences. Nucleic acid molecules that encode only the ectodomain of the polypeptide are also encompassed by the invention. The nucleic acid molecule can be incorporated into a vector, such as an expression vector.

In some embodiments, the nucleic acid includes a self-replicating RNA molecule. In some embodiments, the nucleic acid includes a modified RNA molecule. In another aspect, the invention relates to a composition including a nucleic acid according to any one of the embodiments described herein.

Compound-stabilized Polypeptide

The inventors discovered a polypeptide stabilized in a prefusion conformation that can be identified by, for example, the binding of a bis(aryl)thiourea compound to an HCMV gB. Bis(aryl)thiourea compounds, as exemplified by structures 1a,b (Formula I), are highly potent and specific inhibitors of CMV. In one aspect, the invention relates to a polypeptide that is capable of binding to a bis(aryl)thiourea compound. In preferred embodiments, the compound does not bind to a postfusion conformation of the HCMV gB polypeptide.

(Formula I)

1a (X = CH)
1b (X = N)

In a preferred embodiment, the compound is a bis(aryl) thiourea thioziole analog thereof. Most preferably, in some embodiments, the compound is N-{4-[({(1S)-1-[3,5-bis(trifluoromethyl)phenyl]ethyl}carbamothioyl)amino]phenyl}-1,3-thiazole-4-carboxamide, having the following structure:

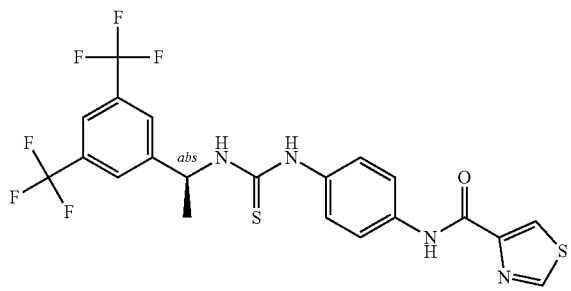 [SMILES: C[C@H](NC(=S)Nc1ccc(NC(=O)c2cscn2)cc1)c1cc(C(F)(F)F)cc(C(F)(F)F)c1]

In another embodiment, the compound has the following structure:

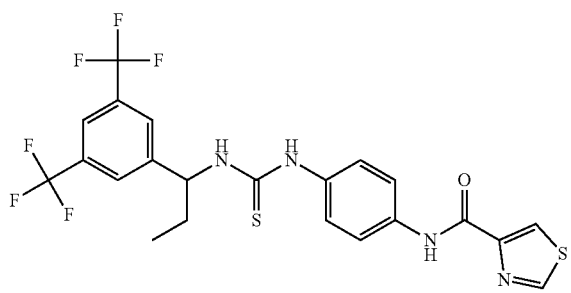 [SMILES: CCC(NC(=S)Nc1ccc(NC(=O)c2cscn2)cc1)c1cc(C(F)(F)F)cc(C(F)(F)F)c1]

In several embodiments, the polypeptide includes an HCMV gB prefusion epitope, which is not present in a native HCMV gB a postfusion conformation.

In some embodiments, at least about 90% of the polypeptides (such as at least about 91%, 92%, 93%, 94%, 95%, 96%, 97%, 98%, 99% or 99.9% of the polypeptides in the homogeneous population are bound by a bis(aryl)thiourea compound (e.g., such as a thiazole analog of bis(aryl) thiourea compounds, more preferably N-{4-[({(1S)-1-[3,5-bis(trifluoromethyl)phenyl]ethyl}carbamothioyl) amino] phenyl}-1,3-thiazole-4-carboxamide). In some embodiments, the polypeptide that can bind to the bis(aryl) thiourea compound does not have a postfusion conformation. Rather, the polypeptide has a prefusion conformation, such as an HCMV gB prefusion conformation.

In another embodiment, the polypeptide can be at least 80% isolated, at least 90%, 95%, 98%, 99%, or preferably 99.9% isolated from HCMV gB polypeptides that are not specifically bound by a bis(aryl)thiourea compound.

Compositions Including a Polypeptide and Methods of Use Thereof

The invention relates to compositions and methods of using the polypeptide described herein, or a nucleic acid encoding such polypeptide described herein. For example, the polypeptide of the invention can be delivered directly as a component of an immunogenic composition. Alternatively, nucleic acids that encode the polypeptide of the invention can be administered to produce the polypeptide or immunogenic fragment in vivo. Certain preferred embodiments, such as protein formulations, recombinant nucleic acids (e.g., DNA, RNA, self-replicating RNA, or any variation thereof) and viral vectors (e.g., live, single-round, non-replicative assembled virions, or otherwise virus-like particles, or alphavirus VRP) that contain sequences encoding polypeptides are further described herein and may be included in the composition.

In one aspect, the invention provides an immunogenic composition comprising the polypeptide described herein. The immunogenic composition can include additional CMV proteins, such as gO, gH, gL, pUL128, pUL130, pUL131, pp65, an immunogenic fragment thereof, or a combination thereof. For example, the polypeptide can be combined with CMV pentameric complex comprising: gH or a pentamer-forming fragment thereof, gL or a pentamer-forming fragment thereof, pUL128 or a pentamer-forming fragment thereof, pUL130 or a pentamer-forming fragment thereof, and pUL131 or a pentamer-forming fragment thereof. The polypeptide of the invention can also be combined with CMV trimeric complex comprising: gH or a trimer-forming fragment thereof, gL or a trimer-forming fragment thereof, and gO or a trimer-forming fragment thereof.

In another aspect, the invention relates to a composition including a polynucleotide that may elicit an immune response in a mammal. The polynucleotide encodes at least one polypeptide of interest, e.g., an antigen. Antigens disclosed herein may be wild type (i.e., derived from the infectious agent) or preferably modified (e.g., engineered, designed or artificial). The nucleic acid molecules described herein, specifically polynucleotides, in some embodiments, encode one or more peptides or polypeptides of interest. Such peptides or polypeptides may serve as an antigen or antigenic molecule. The term "nucleic acid" includes any compound that includes a polymer of nucleotides. These polymers are referred to as "polynucleotides." Exemplary nucleic acids or polynucleotides of the invention include, but are not limited to, ribonucleic acids (RNAs), including mRNA, and deoxyribonucleic acids (DNAs).

In some embodiments, the composition includes DNA encoding a polypeptide or fragment thereof described herein. In some embodiments, the composition includes RNA encoding a polypeptide or fragment thereof described herein. In some embodiments, the composition includes an mRNA polynucleotide encoding a polypeptide or fragment thereof described herein. Such compositions may produce the appropriate protein conformation upon translation.

In one aspect, the invention relates to a composition that includes at least one polynucleotide encoding a polypeptide including at least one amino acid mutation relative to the amino acid sequence of the wild-type HCMV gB.

In one aspect, the invention relates to a composition that includes at least one DNA polynucleotide encoding a polypeptide including at least one amino acid mutation relative to the amino acid sequence of the wild-type HCMV gB.

In one aspect, the invention relates to a composition that includes at least one RNA polynucleotide encoding a polypeptide including at least one amino acid mutation relative to the amino acid sequence of the wild-type HCMV gB.

In some embodiments, the invention relates to a composition that includes at least one polynucleotide encoding at least one hCMV gB polypeptide or an immunogenic fragment or epitope thereof.

In some embodiments, the composition includes at least one polynucleotide encoding two or more antigenic polypeptides or an immunogenic fragment or epitope thereof. In some embodiments, the composition includes two or more polynucleotides encoding two or more antigenic polypeptides or immunogenic fragments or epitopes thereof. The one or more antigenic polypeptides may be encoded on a single polynucleotide or may be encoded individually on multiple (e.g., two or more) polynucleotides.

In another aspect, the invention relates to a composition that includes (a) a polynucleotide encoding a polypeptide including at least one introduced amino acid mutation relative to the amino acid sequence of the wild-type HCMV glycoprotein B (gB); and (b) a polynucleotide encoding an additional polypeptide.

In another aspect, the invention relates to a composition that includes (a) a polynucleotide encoding a polypeptide including at least one introduced amino acid mutation relative to the amino acid sequence of the wild-type HCMV glycoprotein B (gB); and (b) a polynucleotide encoding an additional polypeptide, preferably an HCMV antigenic polypeptide. The additional polypeptide may be selected from HCMV gH, gL, gB, gO, gN, and gM and an immunogenic fragment or epitope thereof. In some embodiments, the additional polypeptide is HCMV pp65. In some embodiments, the additional polypeptide may be selected from gH, gL, gO, gM, gN, UL128, UL130, and UL131A, and fragments thereof. In some embodiments, the additional polypeptide is HCMV gH polypeptide. In some embodiments, the additional polypeptide is an HCMV gL polypeptide. In some embodiments, the additional polypeptide is an HCMV gB polypeptide. In some embodiments, the additional polypeptide is an HCMV gO polypeptide. In some embodiments, the additional polypeptide is an HCMV gN polypeptide. In some embodiments, the additional polypeptide is an HCMV gM polypeptide. In some embodiments, the additional polypeptide is a variant gH polypeptide, a variant gL polypeptide, or a variant gB polypeptide. In some embodiments, the variant HCMV gH, gL, or gB polypeptide is a truncated polypeptide lacking one or more of the following domain sequences: (1) the hydrophobic membrane proximal domain, (2) the transmembrane domain, and (3) the cytoplasmic domain. In some embodiments, the truncated HCMV gH, gL, or gB polypeptide lacks the hydrophobic membrane proximal domain, the transmembrane domain, and the cytoplasmic domain. In some embodiments, the truncated HCMV gH, gL, or gB polypeptide includes only the ectodomain sequence. In some embodiments, an antigenic polypeptide is an HCMV protein selected from UL83, UL123, UL128, UL130 and UL131A or an immunogenic fragment or epitope thereof. In some embodiments, the antigenic polypeptide is an HCMV UL83 polypeptide. In some embodiments, the antigenic polypeptide is an HCMV UL123 polypeptide. In some embodiments, the antigenic polypeptide is an HCMV UL128 polypeptide. In some embodiments, the antigenic polypeptide is an HCMV UL130 polypeptide. In some embodiments, the antigenic polypeptide is an HCMV UL131 polypeptide.

In another aspect, the invention relates to a composition that includes (a) a polynucleotide encoding a polypeptide including at least one introduced amino acid mutation relative to the amino acid sequence of the wild-type HCMV glycoprotein B (gB); and (b) a polynucleotide encoding an additional polypeptide having any one of the amino acid sequences SEQ ID NOs: 211-223. In another aspect, the invention relates to a composition that includes (a) a polynucleotide encoding a polypeptide including at least one introduced amino acid mutation relative to the amino acid sequence of the wild-type HCMV glycoprotein B (gB); and (b) a polynucleotide having any one of the sequences selected from SEQ ID NOs: 141-210. In another aspect, the invention relates to a composition that includes (a) a polynucleotide encoding a polypeptide including at least one introduced amino acid mutation relative to the amino acid sequence of the wild-type HCMV glycoprotein B (gB); and (b) an additional polypeptide having any one of the amino acid sequences selected from SEQ ID NOs: 211-223. In some embodiments, the polynucleotide encoding the additional polypeptide includes at least one nucleic acid sequence selected from any of SEQ ID NOs: 224-254. In some embodiments, the polynucleotide encoding the additional polypeptide includes at least one nucleic acid sequence selected from any of SEQ ID NOs: 141-147. In some embodiments, the polynucleotide encoding the additional polypeptide has at least one sequence selected from any of SEQ ID NOs: 220-223.

In some embodiments, the antigenic polypeptide includes two or more HCMV proteins, fragments, or epitopes thereof. In some embodiments, the antigenic polypeptide includes two or more glycoproteins, fragments, or epitopes thereof. In some embodiments, the antigenic polypeptide includes at least one HCMV polypeptide, fragment or epitope thereof and at least one other HCMV protein, fragment or epitope thereof. In some embodiments, the two or more HCMV polypeptides are encoded by a single RNA polynucleotide. In some embodiments, the two or more HCMV polypeptides are encoded by two or more RNA polynucleotides, for example, each HCMV polypeptide is encoded by a separate RNA polynucleotide. In some embodiments, the two or more HCMV polypeptides can be any combination of HCMV gH, gL, gB, gO, gN, and gM polypeptides or immunogenic fragments or epitopes thereof. In some embodiments, the two or more glycoproteins includes pp65 or immunogenic fragments or epitopes thereof; and any combination of HCMV gH, gL, gB, gO, gN, and gM polypeptides or immunogenic fragments or epitopes thereof. In some embodiments, the two or more glycoproteins can be any combination of HCMV gB and one or more HCMV polypeptides selected from gH, gL, gO, gN, and gM polypeptides or immunogenic fragments or epitopes thereof. In some embodiments, the two or more glycoproteins can be any combination of HCMV gH and one or more HCMV polypeptides selected from gL, gO, gN, and gM polypeptides or immunogenic fragments or epitopes thereof. In some embodiments, the two or more glycoproteins can be any combination of HCMV gL and one or more HCMV polypeptides selected from gB, gH, gO, gN, and gM polypeptides or immunogenic fragments or epitopes thereof. In some embodiments, the two or more HCMV polypeptides are gB and gH. In some embodiments, the two or more HCMV polypeptides are gB and gL. In some embodiments, the two or more HCMV polypeptides are gH and gL. In some embodiments, the two or more HCMV polypeptides are gB, gL, and gH. In some embodiments, the two or more HCMV proteins can be any combination of HCMV UL83, UL123, UL128, UL130, and UL131A polypeptides or immunogenic fragments or epitopes thereof. In some embodiments, the two or more HCMV polypeptides are UL123 and UL130. In some embodiments, the two or more HCMV polypeptides are UL123 and 131 A. In some embodiments, the two or more HCMV polypeptides are UL130 and 131 A. In some embodiments, the two or more HCMV polypeptides are UL 128, UL130 and 131 A. In some embodiments, the two or more HCMV proteins can be any combination of HCMV gB, gH, gL, gO, gM, gN, UL83, UL123, UL128, UL130, and UL131A polypeptides or immunogenic fragments or epitopes thereof. In some embodiments, the two or more glycoproteins can be any combination of HCMV gH and one or more HCMV polypeptides selected from gL, UL128, UL130, and UL131A polypeptides or immunogenic fragments or epitopes thereof. In some embodiments, the two or more glycoproteins can be any combination of HCMV gL and one or more HCMV polypeptides selected from gH, UL128, UL130, and UL131A polypeptides or immunogenic fragments or epitopes thereof. In some embodiments, the two or more HCMV polypeptides are gL, gH, UL 128, UL130 and 131 A. In any of these embodiments in which the composition includes two or more HCMV proteins, the HCMV gH may be a variant gH, such as any of the variant HCMV gH glycoproteins disclosed herein, for example, any of the variant HCMV gH disclosed herein. In any of these embodiments in which the composition includes two or more HCMV proteins, the HCMV gB may be a variant gB, such as any of the variant HCMV gB glycoproteins disclosed herein, for example, any of the variant HCMV gB disclosed herein. In any of these embodiments in which the composition includes two or more HCMV gL proteins, the HCMV gL may be a variant gL, such as any of the variant HCMV gL glycoproteins disclosed herein, for example, any of the variant HCMV gL disclosed herein.

In certain embodiments in which the composition includes two or more RNA polynucleotides encoding two or more HCMV antigenic polypeptides or an immunogenic fragment or epitope thereof (either encoded by a single RNA polynucleotide or encoded by two or more RNA polynucleotides, for example, each protein encoded by a separate RNA polynucleotide), the two or more HCMV proteins are a variant gB, for example, any of the variant gB polypeptides disclosed herein, and an HCMV protein selected from gH, gL, gO, gM, gN, UL128, UL130, and UL131 polypeptides or immunogenic fragments or epitopes thereof. In some embodiments, the two or more HCMV proteins are a variant gH, for example, any of the variant gH polypeptides disclosed herein, and an HCMV protein selected from gH, gL, gO, gM, gN, UL128, UL130, and UL131A polypeptides or immunogenic fragments or epitopes thereof. In some embodiments, the two or more HCMV proteins are a variant gH, for example, any of the variant gH polypeptides disclosed herein, and an HCMV protein selected from gH, gL, gO, gM, gN, UL128, UL130, and UL131 polypeptides or immunogenic fragments or epitopes thereof. In some embodiments in which the variant HCMV proteins are variant HCMV gB, variant HCMV gL, and variant HCMV gH, the variant HCMV polypeptide is a truncated polypeptide selected from the following truncated polypeptides: lacks the hydrophobic membrane proximal domain; lacks the transmembrane domain; lacks the cytoplasmic domain; lacks two or more of the hydrophobic membrane proximal, transmembrane, and cytoplasmic domains; and includes only the ectodomain. In some embodiments, the composition includes multimeric RNA polynucleotides encoding at least one HCMV antigenic polypeptide or an immunogenic fragment or epitope thereof. In some embodiments, the composition includes at least one RNA polynucleotide encoding at least one HCMV antigenic polypeptide or an immunogenic fragment or epitope thereof, wherein the 5'UTR of the RNA polynucleotide includes a patterned UTR. In some embodiments, the patterned UTR has a repeating or alternating pattern, such as ABABAB or AABBAABBAABB or ABCABCABC or variants thereof repeated once, twice, or more than 3 times. In these patterns, each letter, A, B, or C represent a different UTR at the nucleotide level. In some embodiments, the 5' UTR of the RNA polynucleotide (e.g., a first nucleic acid) has regions of complementarity with a UTR of another RNA polynucleotide (a second nucleic acid). For example, UTR nucleotide sequences of two polynucleotides sought to be joined (e.g., in a multimeric molecule) can be modified to include a region of complementarity such that the two UTRs hybridize to form a multimeric molecule. In some embodiments, the 5' UTR of an RNA polynucleotide encoding an HCMV antigenic polypeptide is modified to allow the formation of a multimeric sequence. In some embodiments, the 5' UTR of an RNA polynucleotide encoding an HCMV protein selected from UL128, UL130, UL131 is modified to allow the formation of a multimeric sequence. In some embodiments, the 5' UTR of an RNA polynucleotide encoding an HCMV polypeptide is modified to allow the formation of a multimeric sequence. In some embodiments, the 5' UTR of an RNA polynucleotide encoding an HCMV polypeptide selected from gH, gL, gB, gO, gM, and gN is modified to allow the formation of a multimeric sequence. In any of these embodiments, the multimer may be a dimer, a trimer, pentamer, hexamer, heptamer, octamer nonamer, or decamer. Thus, in some embodiments, the 5' UTR of an RNA polynucleotide encoding an HCMV protein selected from gH, gL, gB, gO, gM, gN, UL128, UL130, and UL131 is modified to allow the formation of a dimer. In some embodiments, the 5' UTR of an RNA polynucleotide encoding an HCMV protein selected from gH, gL, gB, gO, gM, gN, UL128, UL130, and UL131A is modified to allow the formation of a trimer. In some embodiments, the 5' UTR of an RNA polynucleotide encoding an HCMV protein selected from gH, gL, gB, gO, gM, gN, UL128, UL130, and UL131 is modified to allow the formation of a pentamer. In some embodiments, the composition includes at least one RNA polynucleotide having a single open reading frame encoding two or more (for example, two, three, four, five, or more) HCMV antigenic polypeptides or an immunogenic fragment or epitope thereof. In some embodiments, the composition includes at least one RNA polynucleotide having more than one open reading frame, for example, two, three, four, five or more open reading frames encoding two, three, four, five or more HCMV antigenic polypeptides. In either of these embodiments, the at least one RNA polynucleotide may encode two or more HCMV antigenic polypeptides selected from gH, gB, gL, gO, gM, gN, UL83, UL123, UL128, UL130, UL131A, and fragments or epitopes thereof. In some embodiments, the at least one RNA polynucleotide encodes UL83 and UL123. In some embodiments, the at least one RNA polynucleotide encodes gH and gL. In some embodiments, the at least one RNA polynucleotide encodes UL128, UL130, and UL131. In some embodiments, the at least one RNA polynucleotide encodes gH, gL, UL128, UL130, and UL131. In some embodiments, in which the at least one RNA polynucleotide has a single open reading frame encoding two or more (for example, two, three, four, five, or more) HCMV antigenic polypeptides, the RNA polynucleotide further comprises additional sequence, for example, a linker sequence or a sequence that aids in the processing of the HCMV RNA transcripts or polypeptides, for example a cleavage site sequence. In some embodiments, the additional sequence may be a protease sequence, such as a furin sequence. In some embodiments, the additional sequence may be self-cleaving 2A peptide, such as a P2A, E2A, F2A, and T2A sequence. In some embodiments, the linker sequences and cleavage site sequences are interspersed between the sequences encoding HCMV polypeptides.

In some embodiments, at least one RNA polynucleotide includes any nucleic acid sequence selected from any one of nucleic acid sequences disclosed herein, or homologs thereof having at least 80% (e.g., 85%, 90%, 95%, 98%, 99%) identity with a nucleic acid sequence disclosed herein. In some embodiments, the open reading frame is encoded is codon-optimized. Some embodiments include a composition that includes at least one RNA polynucleotide encoding at least one HCMV antigenic polypeptide or an immunogenic fragment thereof and at least one 5' terminal cap. In some embodiments, a 5' terminal cap is 7mG(5')ppp(5')NImpNp.

In some embodiments, the at least one polynucleotide includes a nucleic acid sequence selected from any one of SEQ ID NOs: 141-210. In some embodiments, the at least one polynucleotide encodes a polypeptide having at least 90% identity to any one of the amino acid sequences of SEQ ID NOs: 211-223. In some preferred embodiments, the composition does not include a polypeptide having the amino acid sequence SEQ ID NO: 216. In some preferred embodiments, the composition does not include a polynucleotide encoding the amino acid sequence SEQ ID NO: 216. In some preferred embodiments, the composition does not include a polynucleotide having the sequence SEQ ID NO: 152.

In some embodiments, the composition includes at least one polynucleotide, wherein the at least one polynucleotide has at least one chemical modification. In some embodiments, the at least one polynucleotide further includes a second chemical modification. Preferably, the polynucleotide is RAN. In some embodiments, the at least one polynucleotide having at least one chemical modification has a 5' terminal cap. In some embodiments, the at least one chemical modification is selected from pseudouridine, N1-methylpseudouridine, N1-ethylpseudouridine, N1-ethylpseudouridine, 2-thiouridine, 4'-thiouridine, 5-methylcytosine, 2-thio-1-methyl-1-deaza-pseudouri dine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, dihydropseudouridine, 5-methoxyuridine and 2'-0-methyl uridine. In some embodiments, the composition includes at least one polynucleotide, wherein at least 80% (e.g., 85%, 90%, 95%, 98%, 99%, 100%) of the uracil in the open reading frame has a chemical modification, optionally wherein the composition is formulated in a lipid nanoparticle. In some embodiments, 100% of the uracil in the open reading frame has a chemical modification. In some embodiments, a chemical modification is in the 5-position of the uracil. In some embodiments, a chemical modification is a N1-methyl pseudouridine.

In some embodiments, the additional polypeptides or immunogenic fragments encoded by the polynucleotide (e.g., in an mRNA composition) are selected from gB, gH, gL, gO, gM, gN, UL83, UL123, UL128, UL130, UL131A, pp65 and IE1 antigens.

In some embodiments, a first composition and a second composition are administered to the mammal. In some embodiments, a first composition includes a polynucleotide encoding a polypeptide including at least one introduced amino acid mutation relative to the amino acid sequence of the wild-type HCMV gB; and a second composition includes a polynucleotide encoding HCMV pp65 or an antigenic fragment or epitope thereof. In some embodiments, a first composition includes a polynucleotide encoding a polypeptide including at least one introduced amino acid mutation relative to the amino acid sequence of the wild-type HCMV gB; and a second composition includes a polynucleotide encoding at least one polynucleotide encoding an additional polypeptide selected from HCMV gH, gL, UL128, UL130, and UL131, or antigenic fragments or epitopes thereof.

In another aspect, the invention relates to methods of inducing an immune response in a mammal, including administering to the mammal a composition in an amount effective to induce an immune response, wherein the composition includes a polynucleotide encoding a polypeptide including at least one introduced amino acid mutation relative to the amino acid sequence of the wild-type HCMV gB.

In some embodiments, the immune response includes a T cell response or a B cell response. In some embodiments, the immune response includes a T cell response and a B cell response. In some embodiments, the method involves a single administration of the composition. In some embodiments, a method further includes administering to the subject a booster dose of the composition. The composition including a polynucleotide disclosed herein may be formulated in an effective amount to produce an antigen specific immune response in a mammal.

The immunogenic composition may include an adjuvant. Exemplary adjuvants to enhance effectiveness of the composition include: (1) aluminum salts (alum), such as aluminum hydroxide, aluminum phosphate, aluminum sulfate, etc.; (2) oil-in-water emulsion formulations (with or without other specific adjuvants such as muramyl peptides (see below) or bacterial cell wall components), such as for example (a) MF59 (PCT Publ. No. WO 90/14837), containing 5% Squalene, 0.5% TWEEN 80, and 0.5% Span 85 formulated into submicron particles using a microfluidizer, (b) SAF, containing 10% Squalane, 0.4% Tween 80, 5% pluronic-blocked polymer L121, and thr-MDP either microfluidized into a submicron emulsion or vortexed to generate a larger particle size emulsion, and (c) RIBI™ adjuvant system (RAS), (Ribi Immunochem, Hamilton, Mont.) containing 2% Squalene, 0.2% Tween 80, and one or more bacterial cell wall components from the group consisting of monophosphorylipid A (MPL), trehalose dimycolate (TDM), and cell wall skeleton (CWS), preferably MPL+CWS (DETOX™); (3) saponin adjuvants, such as QS-21, STIMULON™ (Cambridge Bioscience, Worcester, Mass.), which may be used or particles generated therefrom such as ISCOMs (immunostimulating complexes); (4) Complete Freunds Adjuvant (CFA) and Incomplete Freunds Adjuvant (IFA); (5) cytokines, such as interleukins (IL-1, IL-2, etc.), macrophage colony stimulating factor (M-CSF), tumor necrosis factor (TNF), etc.; and (6) other substances that act as adjuvants to enhance the effectiveness of the composition. In a preferred embodiment, the adjuvant is a saponin adjuvant, namely QS-21. In some embodiments, the composition does not include an adjuvant. In some embodiments, the composition further includes a lipid nanoparticle. In some embodiments, the composition is formulated in a nanoparticle. In some embodiments, the composition further includes a cationic or polycationic compounds, including protamine or other cationic peptides or proteins, such as poly-L-lysine (PLL).

Each of the immunogenic compositions discussed herein may be used alone or in combination with one or more other antigens, the latter either from the same viral pathogen or from another pathogenic source or sources. These compositions may be used for prophylactic (to prevent infection) or therapeutic (to treat disease after infection) purposes.

In one embodiment, the composition may include a "pharmaceutically acceptable carrier," which includes any carrier that does not itself induce the production of antibodies harmful to the individual receiving the composition. Suitable carriers are typically large, slowly metabolized macromolecules such as proteins, polysaccharides, polylactic acids, polyglycolic acids, polymeric amino acids, amino acid copolymers, lipid aggregates (such as oil droplets or liposomes), and inactive virus particles. Such carriers are well known to those of ordinary skill in the art. Additionally, these carriers may function as adjuvants. Furthermore, the antigen may be conjugated to a bacterial toxoid, such as a toxoid from diphtheria, tetanus, cholera, *H. pylori*, and etc. pathogens.

In one embodiment, the composition includes a diluent, such as water, saline, glycerol, ethanol, etc. Additionally, auxiliary substances, such as wetting or emulsifying agents, pH buffering substances, and the like, may be present in such vehicles.

The compositions described herein may include an immunologically effective amount of the polypeptide or polynucleotide, as well as any other of the above-mentioned components, as needed. By "immunologically effective amount," it is meant that the administration of that amount to an individual, either in a single dose or as part of a series, is effective for eliciting an immune response. The immune response elicited may be sufficient, for example, for treatment and/or prevention and/or reduction in incidence of illness, infection or disease. This amount varies depending upon the health and physical condition of the individual to be treated, the taxonomic group of individual to be treated (e.g., nonhuman primate, primate, etc.), the capacity of the individual's immune system to synthesize antibodies, the degree of protection desired, the formulation of the vaccine, the treating doctors assessment of the medical situation, and other relevant factors. It is expected that the amount will fall in a relatively broad range that can be determined through routine trials.

The composition may be administered parenterally, e.g., by injection, either subcutaneously or intramuscularly. In some embodiments, the composition is administered to the mammal by intradermal or intramuscular injection. Additional formulations suitable for other modes of administration include oral and pulmonary formulations, nasal formulations, suppositories, and transdermal applications. Oral formulations may be preferred for certain viral proteins. Dosage treatment may be a single dose schedule or a multiple dose schedule. The immunogenic composition may be administered in conjunction with other immunoregulatory agents.

In another aspect, the invention provides a method of eliciting an immune response against cytomegalovirus, comprising administering to a subject in need thereof an immunologically effective amount of the polypeptide and/or an immunogenic composition described herein, which comprises the proteins, DNA molecules, RNA molecules (e.g., self-replicating RNA molecules), or VRPs as described above. In certain embodiments, the immune response comprises the production of neutralizing antibodies against CMV.

The immune response can comprise a humoral immune response, a cell-mediated immune response, or both. In some embodiments an immune response is induced against each delivered CMV protein. A cell-mediated immune response can comprise a Helper T-cell (Th) response, a CD8+ cytotoxic T-cell (CTL) response, or both. In some embodiments the immune response comprises a humoral immune response, and the antibodies are neutralizing antibodies.

Neutralizing antibodies block viral infection of cells. CMV infects epithelial cells and also fibroblast cells. In some embodiments the immune response reduces or prevents infection of both cell types. Neutralizing antibody responses can be complement-dependent or complement-independent. In some embodiments the neutralizing antibody response is complement-independent. In some embodiments the neutralizing antibody response is cross-neutralizing; i.e., an antibody generated against an administered composition neutralizes a CMV virus of a strain other than the strain used in the composition.

The polypeptide and/or immunogenic composition described herein may also elicit an effective immune response to reduce the likelihood of a CMV infection of a non-infected mammal, or to reduce symptoms in an infected mammal, e.g., reduce the number of outbreaks, CMV shedding, and risk of spreading the virus to other mammals.

In one aspect, the invention relates to a method for reducing CMV viral shedding in a mammal. In some embodiments, the invention relates to a method for reducing CMV viral shedding in urine in a mammal. In some embodiments, the invention relates to a method for reducing CMV viral shedding in saliva in a mammal. In another aspect, the invention relates to a method for reducing CMV viral titers in a mammal. In one aspect, the invention relates to a method for reducing CMV nucleic acids in serum in a mammal. The term "viral shedding" is used herein according to its plain ordinary meaning in medicine and virology and refers to the production and release of virus from an infected cell. In some embodiments, the virus is released from a cell of a mammal. In some embodiments, virus is released into the environment from an infected mammal. In some embodiments the virus is released from a cell within a mammal.

In one aspect, the invention relates to a method for reducing CMV viral shedding in a mammal. The method includes administering the modified CMV gB polypeptide and/or immunogenic composition described herein to the mammal that is infected with or is at risk of a CMV infection. In one embodiment, the reduction in CMV viral shedding in a mammal is as compared to the viral shedding in mammals that were not administered the modified CMV gB. In another embodiment, the reduction in CMV viral shedding in a mammal is as compared to the viral shedding following an administration of a CMV pentamer alone or following an administration of a CMV pentamer in the absence of the polypeptide.

In some embodiments, the mammal is a human. In some embodiments, the human is a child, such as an infant. In some other embodiments, the human is female, including an adolescent female, a female of childbearing age, a female who is planning pregnancy, a pregnant female, and females who recently gave birth. In some embodiments, the human is a transplant patient.

In one embodiment, the challenge cytomegalovirus strain is a human CMV strain. In one embodiment, the challenge cytomegalovirus strain is homologous to the CMV strain from which the polypeptide is derived. In another embodiment, the challenge cytomegalovirus strain is homologous to the CMV strain VR1814. In another embodiment, the challenge cytomegalovirus strain is homologous to the CMV strain Towne.

In one embodiment, the challenge cytomegalovirus strain is a human CMV strain that is heterologous to the CMV strain from which the modified CMV gB polypeptide is derived. In another embodiment, the challenge cytomegalovirus strain is a human CMV strain that is heterologous to the VR1814 CMV strain. In another embodiment, the challenge cytomegalovirus strain is the VR1814 CMV strain. In another embodiment, the challenge cytomegalovirus strain is a human CMV strain that is heterologous to the CMV strain Towne. In another embodiment, the challenge cytomegalovirus strain is the CMV strain Towne.

In another embodiment, the challenge cytomegalovirus strain is a rhesus CMV strain homologous to the macacine herpesvirus 3 isolate 21252 CMV strain. In another embodiment, the challenge cytomegalovirus strain is the macacine herpesvirus 3 isolate 21252 CMV strain.

A useful measure of antibody potency in the art is "50% neutralization titer." Another useful measure of antibody potency is any one of the following: a "60% neutralization titer"; a "70% neutralization titer"; a "80% neutralization titer"; and a "90% neutralization titer." To determine, for example, a 50% neutralizing titer, serum from immunized animals is diluted to assess how dilute serum can be yet retain the ability to block entry of 50% of infectious viruses into cells. For example, a titer of 700 means that serum retained the ability to neutralize 50% of infectious virus after being diluted 700-fold. Thus, higher titers indicate more potent neutralizing antibody responses. In some embodiments, this titer is in a range having a lower limit of about 200, about 400, about 600, about 800, about 1000, about 1500, about 2000, about 2500, about 3000, about 3500, about 4000, about 4500, about 5000, about 5500, about 6000, about 6500, or about 7000. The 50%, 60%, 70%, 80%, or 90% neutralization titer range can have an upper limit of about 400, about 600, about 800, about 1000, about 1500, about 2000, about 2500, about 3000, about 3500, about 4000, about 4500, about 5000, about 5500, about 6000, about 6500, about 7000, about 8000, about 9000, about 10000, about 1 1000, about 12000, about 13000, about 14000, about 15000, about 16000, about 17000, about 18000, about 19000, about 20000, about 21000, about 22000, about 23000, about 24000, about 25000, about 26000, about 27000, about 28000, about 29000, or about 30000. For example, the 50% neutralization titer can be about 3000 to about 6500. "About" means plus or minus 10% of the recited value. Neutralization titer can be measured as described in the specific examples, below.

An immune response can be stimulated by administering proteins, DNA molecules, RNA molecules (e.g., self-replicating RNA molecules or nucleoside modified RNA molecules), or VRPs to an individual, typically a mammal, including a human. In some embodiments the immune response induced is a protective immune response, i.e., the response reduces the risk or severity of or clinical consequences of a CMV infection. Stimulating a protective immune response is particularly desirable in some populations particularly at risk from CMV infection and disease. For example, at-risk populations include solid organ transplant (SOT) patients, bone marrow transplant patients, and hematopoietic stem cell transplant (HSCT) patients. VRPs can be administered to a transplant donor pre-transplant, or a transplant recipient pre- and/or post-transplant. Because vertical transmission from mother to child is a common source of infecting infants, administering VRPs to a woman who is pregnant or can become pregnant is particularly useful.

Any suitable route of administration can be used. For example, a composition can be administered intramuscularly, intraperitoneally, subcutaneously, or transdermally. Some embodiments will be administered through an intramucosal route such as intra-orally, intra-nasally, intra-vaginally, and intra-rectally. Compositions can be administered according to any suitable schedule.

Also provided herein is a method of inhibiting cytomegalovirus entry into a cell, comprising contacting the cell with the immunogenic composition described herein.

In one aspect, the invention relates to compositions that include a polypeptide described above. In another aspect, the invention relates to compositions that include a nucleic acid molecule or vector encoding such polypeptide. In a further aspect, the invention relates to compositions that include a polypeptide described above and a nucleic acid molecule or vector encoding such polypeptide.

In some embodiments, the composition is an immunogenic composition capable of eliciting an immune response against CMV in a subject. In some particular embodiments, the immunogenic composition is a pharmaceutical composition, which includes a polypeptide provided by the present disclosure and a pharmaceutically acceptable carrier. In still other embodiments, the pharmaceutical composition is a vaccine.

In some embodiments, a composition, such as an immunogenic composition or a vaccine, includes two or more different polypeptides described above. The two or more different polypeptides may include the same introduced amino acid mutations but may be derived from gB from different HCMV strains or subtypes. In another embodiment, the two or more different polypeptides may include amino acid mutations, as compared to a native HCMV gB, that differ from one another.

In preferred embodiments, the polypeptide is soluble in aqueous solution. In some embodiments, the polypeptide is soluble in a solution that lacks detergent.

Antibodies and Diagnostic Uses

The polypeptides described above may be used to produce antibodies, both polyclonal and monoclonal. If polyclonal antibodies are desired, a selected mammal (e.g., mouse, rabbit, goat, guinea pig, horse, etc.) is immunized with an immunogenic polypeptide bearing a CMV epitope(s). Serum from the immunized animal is collected and treated according to known procedures. If serum containing polyclonal antibodies to a CMV epitope contains antibodies to other antigens, the polyclonal antibodies can be purified by immunoaffinity chromatography. Techniques for producing and processing polyclonal antisera are known in the art.

Monoclonal antibodies directed against CMV epitopes can also be readily produced by one skilled in the art. The general methodology for making monoclonal antibodies by hybridomas is known. Immortal antibody-producing cell lines can be created by cell fusion, and also by other techniques such as direct transformation of B lymphocytes with oncogenic DNA, or transfection with Epstein-Barr virus. Panels of monoclonal antibodies produced against CMV epitopes can be screened for various properties; i.e., for isotype, epitope affinity, etc.

Antibodies, both monoclonal and polyclonal, which are directed against CMV epitopes are particularly useful in diagnosis, and those which are neutralizing are useful in passive immunotherapy. Monoclonal antibodies, in particular, may be used to raise anti-idiotype antibodies.

Both the polypeptides which react immunologically with serum containing CMV antibodies, and the antibodies raised against these polypeptides, may be useful in immunoassays to detect the presence of CMV antibodies, or the presence of the virus, in biological samples, including for example, blood or serum samples. Design of the immunoassays is subject to a great deal of variation, and a variety of these are known in the art. For example, the immunoassay may utilize the polypeptide having the sequence set forth in any one of SEQ ID NOs: 2-43.

Alternatively, the immunoassay may use a combination of viral antigens derived from the polypeptides described herein. It may use, for example, a monoclonal antibody directed towards at least one polypeptide described herein, a combination of monoclonal antibodies directed towards the polypeptides described herein, monoclonal antibodies directed towards different viral antigens, polyclonal antibodies directed towards the polypeptides described herein, or polyclonal antibodies directed towards different viral antigens. Protocols may be based, for example, upon competition, or direct reaction, or may be sandwich type assays. Protocols may also, for example, use solid supports, or may be by immunoprecipitation. Most assays involve the use of labeled antibody or polypeptide; the labels may be, for example, fluorescent, chemiluminescent, radioactive, or dye molecules. Assays which amplify the signals from the probe are also known; examples of which are assays which utilize biotin and avidin, and enzyme-labeled and mediated immunoassays, such as ELISA assays.

Kits suitable for immunodiagnosis and containing the appropriate labeled reagents are constructed by packaging the appropriate materials, including the polypeptides of the invention containing CMV epitopes or antibodies directed against epitopes in suitable containers, along with the remaining reagents and materials required for the conduct of the assay, as well as a suitable set of assay instructions.

The polynucleotide probes can also be packaged into diagnostic kits. Diagnostic kits include the probe DNA, which may be labeled; alternatively, the probe DNA may be unlabeled and the ingredients for labeling may be included in the kit. The kit may also contain other suitably packaged reagents and materials needed for the particular hybridization protocol, for example, standards, as well as instructions for conducting the test.

EXAMPLES

The following Examples illustrate embodiments of the invention.

Example 1

Figure 5A:
FIG. 5A-D—FIG. 5A: The location of fusion inhibitor compound N-{4-[({(1S)-1-[3,5-bis(trifluoromethyl)phenyl]ethyl}carbamothioyl)amino]phenyl}-1,3-thiazole-4-carboxamide in the prefusion gB model. The chemical structure of the compound is shown in FIG. 5D.
Figure 5B:
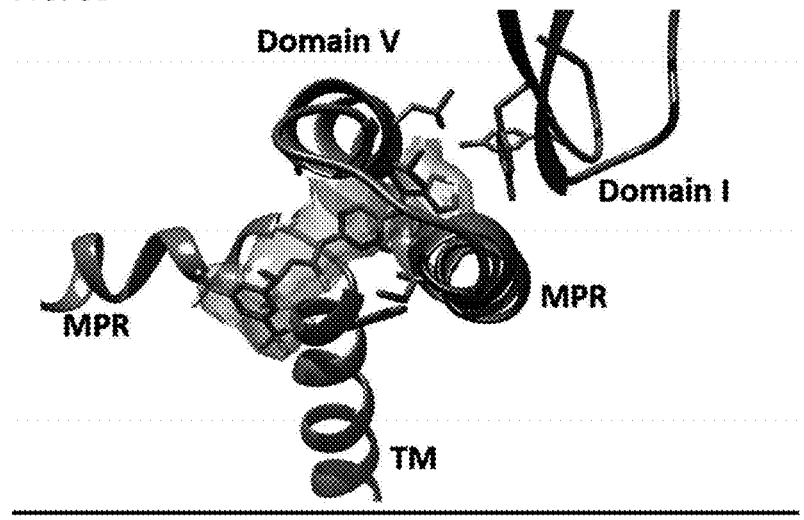
Figure 5C:
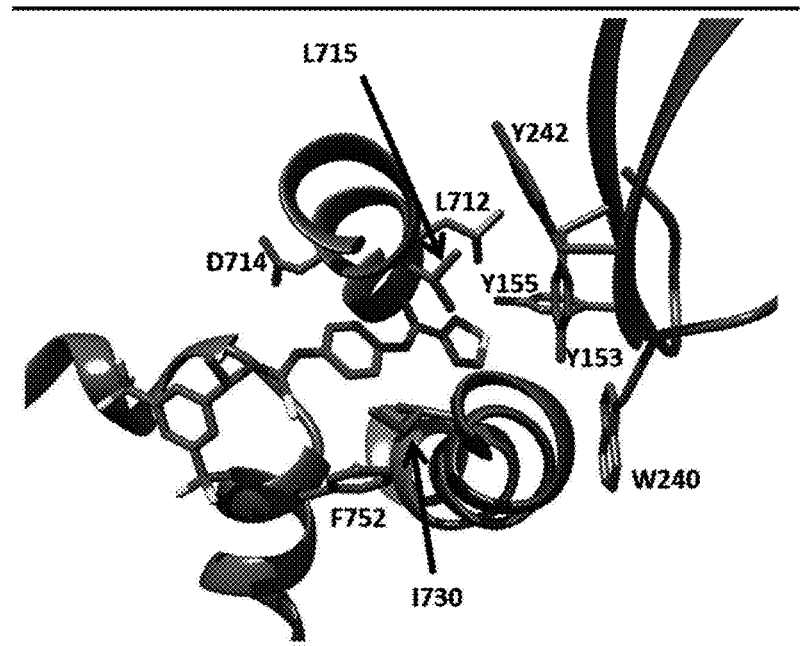
Figure 5D:
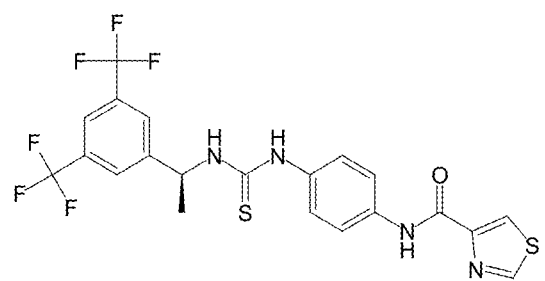

Isolation and Purification of Crosslinked and Native HCMV gB (Towne Strain) with Fusion Inhibitor During the sample preparation the HCMV fusion inhibitor (compound 28 described in Bloom et al., Bioorganic & Medicinal Chemistry Letters 14 (2004) 3401-3406; see also FIG. 5D) was added to each step during the virus concentration, processing, extraction and purification to inhibit conversion of gB to the postfusion form.

Following crosslinking of the proteins on the virion surface with bis(sulfosuccinimidyl) glutarate ($BS^2G$) and extraction of gB from the virion with detergent, the SM5-1 His/Strep-tagged Fab (Potzsch et al., PLoS pathogens 7(8):e1002172, 2011) was added to assist in purification and identification of gB by electron cryomicroscopy. The Fab-gB complexes were purified by an affinity column.

These extracted and purified proteins were then analyzed by electron cryomicroscopy for the presence of prefusion gB and used to solve the structure of a prefusion form.

Example 2

Electron Microscopy

Graphene oxide film-supported electron microscopy grids were prepared. The gB sample solutions were vitrified using a Vitrobot (ThermoFisher). The frozen grids were transferred to a FEI Titan Krios transmission electron microscope that operates at 300 kV. Target positions were set up in the SerialEM program, and high magnification (18000×) images were automatically collected with the program using a K2 direct detector camera (Gatan) using super resolution movie mode. The unbinned pixel size was 0.638 Å and the beam intensity was ~8 e/unbin pixel/s. The total electron dose on the sample for each movie was ~40 e/Å². A total of 7,771 movies, each with 28 frames, was collected in three sessions.

Image Processing

Drift correction was done using the MotionCor2 program (Zheng S et al., (2016) Anisotropic Correction of Beam-induced Motion for Improved Single-particle Electron Cryo-microscopy, Nature Methods), and the final micrographs were binned 2× and averaged from all frames. Contrast transfer function parameters were calculated with Gctf (Kai Zhang (2016) Gctf: Real-time CTF determination and correction Journal of Structural Biology). For particle picking, the published structure of HCMV gB in postfusion conformation (PDB:5CXF) was used to generate a 30 Å density map using pdb2mrc (EMAN) (Ludtke, S. et al. (1999). EMAN: semiautomated software for high-resolution single-particle reconstructions. J Struct Biol). Projection images from this density maps was generated with project3d (EMAN)(FIG. 1) and used as a template for the automatic particle picking using Gautomatch program (Urnavicius L, et al. (2015) The structure of the dynactin complex and its interaction with dynein. Science). Relion v2.1-beta (Sjors H. W. Scheres, (2012) RELION: Implementation of a Bayesian approach to cryo-EM structure determination. Journal of Structural Biology) was used to extract the resulting ~1.9 million particles and to carry out all subsequent image processing steps, including 2D classification, 3D classification, auto-refinement and post-processing. The 2D classes were put into three groups based on the image features: the first group consisted of the 2D classes that showed features that resemble the crystallographically determined postfusion gB structure (>50%); the second group contained 2D classes with well resolved protein features that do not resemble the structural features from postfusion gB (<10%); the third group contained 2D classes that did not contain clearly defined protein (~40%)(FIG. 1). The first and second groups were further processed with 3D classification, auto refinement and post processing procedures with Relion. Following this processing, a ~3.5 Å resolution electron density map showing the postfusion conformation structure was reconstructed from the first group; a ~3.6 Å resolution electron density map showing a prefusion conformation structure was reconstructed from the second group. Based on these density maps and the known HCMV gB amino acid sequence (Towne strain P13201), atomic models were built with the Coot program (Emsley P. et al (2010) Features and Development of Coot. Acta Crystallographica Section D—Biological Crystallography) for the prefusion and postfusion conformation structures. The postfusion gB crystal structure (PDB accession code 5CXF) and a crystal structure of a complex between the SM5-1 fab and gB domain II (PDB accession code 4OT1) were used as initial models for both structures. For the postfusion structure model, small adjustment was enough to obtain a good fit to the electron density. For the prefusion conformation model, domains I, II, III and IV from the reference PDB model could be docked as rigid bodies into the electron density map as a starting point. Then, adjustments of individual residues were made for optimal fitting. The model for domains V, MPR and TM were de novo build. The models were iteratively refined with the Phenix.real_space_refine tool (Afonine PV et al, (2018) Real-space refinement in PHENIX for cryo-EM and crystallography. Acta Crystallogr D Struct Biol) followed by local manual adjusting for several rounds.

Results

Sample Screening by cryoEM

The prefusion conformation of gB is unstable, with a propensity to rearrange to the postfusion state, including during sample handling. Therefore, the samples studied contained a mixture of gB conformers, complicating structure determination. In addition, there was no pre-existing reliable information on the arrangement of domains or the unique structural features of prefusion gB. We used direct visualization by electron microscopy and image processing to screen different sample preparation conditions. Image sorting by 2D and 3D classification permits multiple structures to be determined from heterogeneous samples. However, it requires large data set so that enough particles for each structure can be combined to produce a class average with good signal. This was especially the case for the gB samples because prefusion gB was a small population in the mixtures. Therefore, we collected ~1,000 movies for each condition, and decided whether to pursue image processing with more data from the same sample or switch to another at the 2D classification stage. The structure of antibody Fab bound postfusion conformation gB was readily obtained from many datasets. The projection images from these Fab-bound postfusion conformation structures were used as a reference to avoid in selecting images for the prefusion image reconstruction. We selected any good class average with protein features that did not resemble any of the postfusion gB projection images for further image processing. We screened dozens of conditions for sample preparation with this strategy and eventually found a sample that produced some alternative 2D classes as a minor species in the particle populations (FIG. 1 right panel, circled in red). Then a total of 7,771 movies were collected from that sample and used for determination of a prefusion gB structure.

Projection images of the antibody Fab-bound postfusion gB structure are shown in the left panel of FIG. 1. The 2D class averages from the dataset collected are shown in the right panel of FIG. 1. Some classes that do not resemble any of the postfusion gB reference 2D projections are circled.

Obtaining a Prefusion Conformation Structure

Approximately 1.9 million raw particle images were automatically selected from the data set. After 2D classification, the images were grouped in to a postfusion class (55% of the particle population) and a prefusion class (10% of the particle population). The two groups were further processed in 3D with C3 symmetry applied to yield a density map of SM5-1 Fab-bound postfusion gB at 3.5 Å resolution and a density map of SM5-1 Fab-bound prefusion gB at 3.6 Å resolution.

Figure 3:
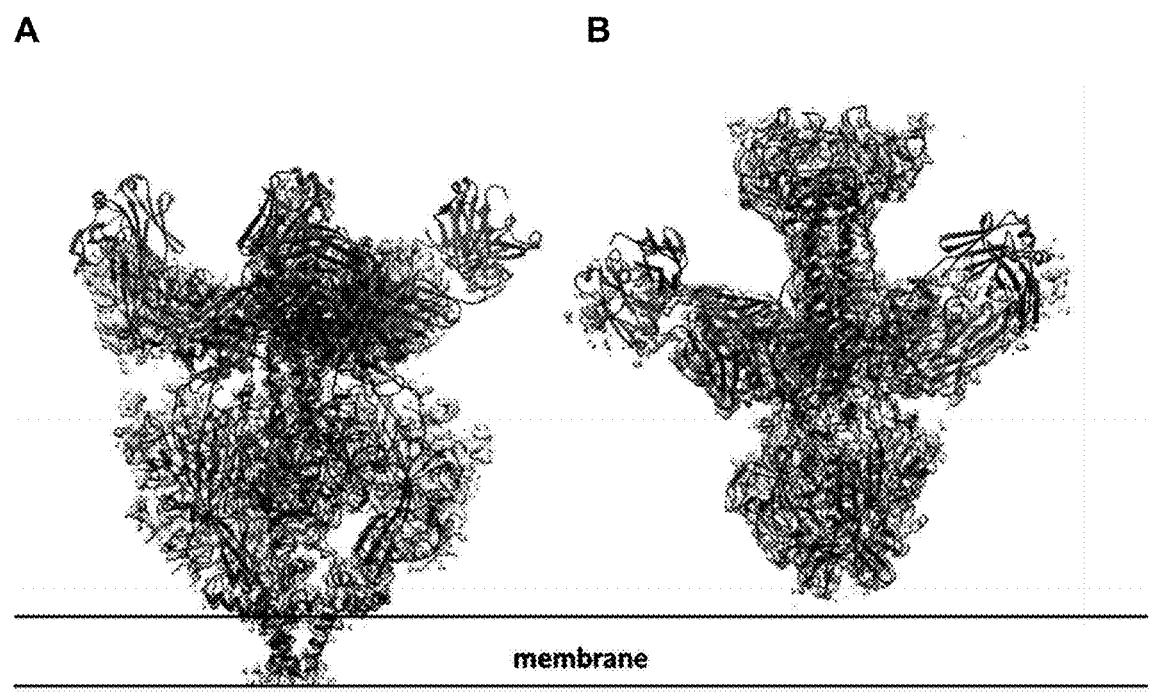
FIG. 3A-B—Fitting of models into the density maps. The models of inhibitor compound stabilized prefusion (FIG. 3A) and postfusion gB conformation (FIG. 3B) are fitted into the semi-transparent grey density maps. gB components are blue, and SM5-1 fab components are magenta. Approximate position of the virus envelope as determined by the position of the TM region in the prefusion structure is indicated by black horizontal lines.

The X-ray crystallography-based models of the SM5-1 Fab and of the ectodomain of postfusion gB were fit to the postfusion density map with rigid body docking. Except for the constant domain of the Fab (which is likely too flexible to produce strong electron density), the density map of the postfusion gB-Fab complex and the model agreed well with each other (FIG. 3, left panel). The membrane proximal region, transmembrane region and cytoplasmic domain were not resolved in our final postfusion gB density map, suggesting that these regions of postfusion gB are flexible either intrinsically or through detergent solubilization in the sample preparations (FIG. 2, lower line). The interaction of the Fab and DII of postfusion gB in the electron cryomicroscopy-based model agrees well with the previously determined crystal structure of the complex (PDB accession code 4OT1).

To build a prefusion gB model, guided by the known Fab binding position, domains I, II, III and part of domain IV from the postfusion gB crystal structure were docked into the density map of the prefusion gB-Fab complex individually and individual residues were manually adjusted as necessary for optimal fit of the electron density. The rest of the prefusion gB structure was built de novo. The amino acids of gB that were modeled in the prefusion structure are indicated in FIG. 2, the top line. The model of the prefusion gB-Fab complex fits most parts of the prefusion density map, and the presence of Fab density confirms the identity of gB in the novel structure (FIG. 3, right panel).

The coordinates and structure factors for the model of the prefusion gB are provided in Table 1.

The Structure of gB in a Prefusion Conformation and Comparison to Postfusion gB

The electron density for the complex of prefusion gB and the SM5-1 Fab allowed the building of a prefusion gB model that includes the gB ectodomain, membrane proximal region (MPR—a helical region that is oriented parallel to the viral membrane), and single span transmembrane helix (TM) (FIGS. 3 and 4, right panel in each). The MPR and TM regions were not resolved in the structural data for postfusion gB or included in postfusion gB models.

The overall dimensions of prefusion and postfusion gB are different (FIG. 4). The postfusion gB trimer ectodomain has a rod shape, with an approximate height of 165 Å (the distance between planes formed by proline 570 of each protomer at the membrane distal end and tryptophan 240 of the each protomer at the membrane proximal end; FIG. 4, left panel). It has a width of approximately 65 Å (the distance between alanine 315 on adjacent protomers). The structures described here were derived from gB of HCMV strain Towne. Although there is some natural variations of gB amino acid sequence, the overall postfusion structure of Towne gB is almost identical to the postfusion structure of gB from the strain AD169 (PDB accession code 5CXF). Thus, the description of the postfusion gB structure applies to both strains with measurements from equivalent amino acids from sequence alignments.

The prefusion gB trimer has a more squat shape than the postfusion gB trimer (FIG. 4). The distance between the plane formed by W240 of each protomer and the most membrane distal modeled residue in the prefusion structure, Q483, is roughly 115 Å. The prefusion model is 95 Å in width (measured by the distance between any two A315 from different protomers).

Figure 6:
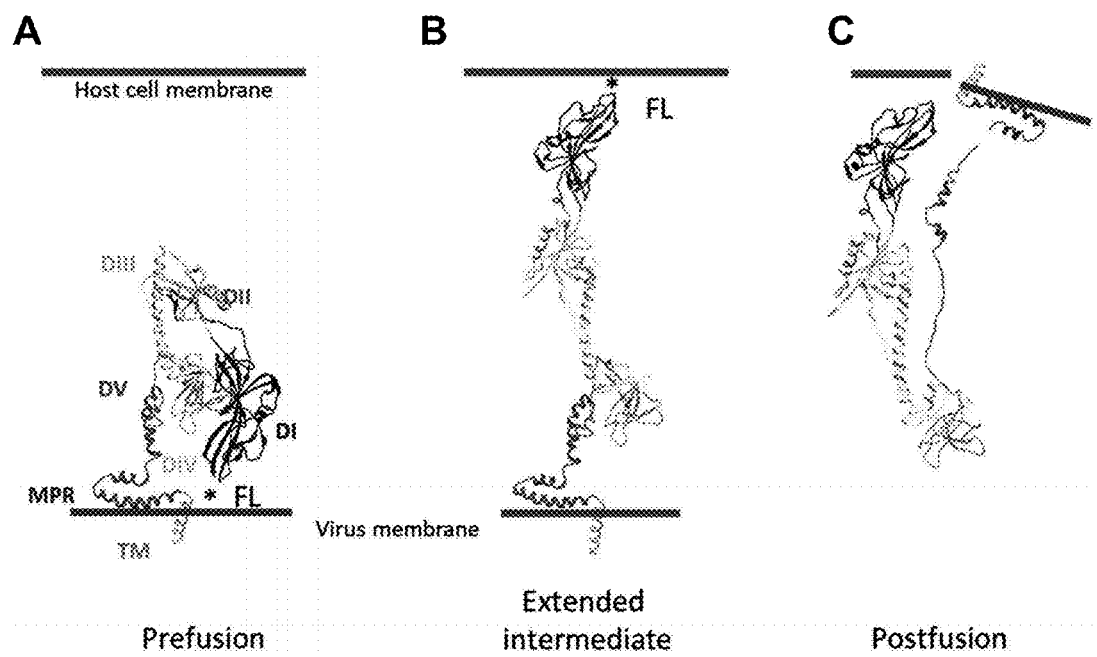
FIG. 6A-C—A model of structural rearrangements of gB during membrane fusion. FL (and asterisks)—fusion loop. DI—domain 1. DII—domain 2. DV—domain 5. TM—transmembrane region. The light blue line depicts the viral membrane. The red line depicts a host cell membrane.
Figure 7:
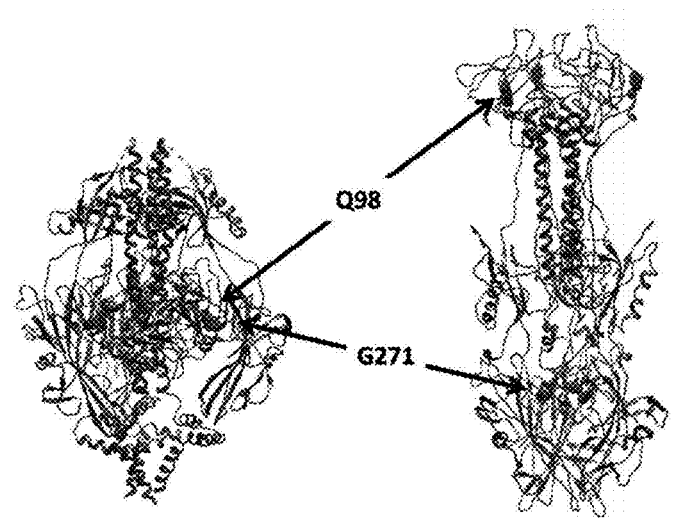
FIG. 7A-B—An exemplary disulfide bond mutation to stabilize gB in a prefusion conformation. The locations of the residues participating in the disulfide bond are depicted as red spheres in a prefusion conformation (FIG. 7A) and postfusion conformation (FIG. 7B).

The individual subunit structures of domains I, II, III and IV are similar in the prefusion and postfusion conformations. However, the overall arrangement of these domains is very different in the two conformations (FIG. 4 and FIG. 6). In the prefusion conformation, the fusion loops at the tip of DI (blue) and the C-termini of the central helix bundle in domain III (yellow) all point in the same direction, toward the virion envelope, as identified by the position of the TM region (FIG. 4, left panel and FIG. 6, left panel). In contrast, in the postfusion conformation, the fusion loops and the C-termini of the central helix bundle point in opposite directions (FIG. 4, right panel).

In the prefusion structure, the hydrophobic residues in the fusion loops (residues Y155, I156, H157 and W240, L241) are in close proximity to the MPR and are likely surrounded by detergents (FIG. 4, left panel and FIG. 6, left panel).

In the transition from prefusion to post fusion, domain II (green) shifts from a position mid-way up the domain III central coiled-coil (yellow) to a position at the membrane proximate end of the coiled-coil and near end of domain I opposite the fusion loops (FIG. 4).

The structure of DIII (yellow in FIG. 4 and FIG. 6) is very similar in the prefusion and postfusion conformations. The central helix in both conformations spans from L479 to P525, indicating a minimal rearrangement during the prefusion to postfusion transition. However, the other domains change their positions relative to the central helix of domain III, so that, as noted above, the direction of the DIII helix bundle (from N-terminal to C-terminal) points away from the fusion loops towards the distal end of the trimer in the postfusion conformation and toward the viral membrane, in the same direction as the fusion loops in the prefusion conformation.

In the prefusion structure, domain IV (brown in FIG. 4 and FIG. 6) is buried at the interface between domain I (blue) on the exterior of the trimer and domains III (yellow) and V (red) at the center of the trimer. In contrast, in the postfusion structure, domain IV forms a highly exposed "crown" at the membrane-distal tip of the trimer.

Domain V (red) has different structures in prefusion gB (FIG. 4, left panel and FIG. 6, left panel) and postfusion gB (FIG. 4 right panel, and FIG. 6, right panel). In prefusion gB, the N-terminal half of the domain (about residues 642-660) is sandwiched between domain I and domain IV of an adjacent protomer (blue) and is sequestered from solvent. The region between residue 683-704 of domain V forms a trimeric helix bundle with its counterpart in other protomers. This helix bundle is cuddled mostly inside of the pocket of the "crown" formed by domain IV. There is an additional short helix (approximately residues 710-719) linking the helix bundle from domain V to the MPR region. In contrast, in the postfusion conformation (FIG. 4, right panel and FIG. 6, right panel), domain V is solvent exposed and extends along the outside of domain III helix bundle (yellow) and the groove formed by the interface between domain I from adjacent protomers.

Comparison of the prefusion and postfusion gB structures suggests a progression of conformational changes that is familiar from other well-studied fusion proteins (Harrison, Virology 0:498-507, 2015). The comparison provides confidence that the structure described in this invention is, in fact, in a prefusion conformation. In the prefusion state (FIG. 6, left panel), the fusion loops of domain I are buried by interaction with the MPR and potentially with the viral membrane. In the prefusion structure of the distant gB homolog, the vesicular stomatitis virus G glycoprotein, the fusion loops also point toward the viral membrane (also the anticipated position of an MPR region, which is not seen in that structure)(Roche et al., Science 315:843-8, 2007).

Based on analogy to other fusion proteins, it is likely that rearrangement proceeds with lengthening of the central helix as part of a transition to a proposed extended intermediate between the prefusion and postfusion states (FIG. 6, middle panel). In the proposed extended intermediate state, the TM region would still be anchored in the viral membrane, and the fusion loops, now extended far from the viral membrane at the tips of a rotated and translocated domain I, would interact with a cellular membrane. The transition from the proposed extended intermediate to the postfusion conformation would involve a fold-back so that the transmembrane region and the fusion loops are again in proximity to each other at the same end of the molecule, this time both interacting with the fused viral and cellular membrane (FIG. 6, right panel).

We speculate that, in prefusion gB, there may be dynamic changes in the length of the central helix, with the prefusion structure we have determined representing a "snapshot" of a "breathing" molecule, locked into the conformation we see in the electron density by the fusion inhibitor and by the cross-linking agent used to prepare the sample studied by electron cryomicroscopy.

Stabilizing Factors for the Observed Prefusion Conformation

After modeling the gB amino acids into the electron density map, a region of density that was not filled by amino acid residues remained between the MPR, domain V, and the tip of domain I that contains the fusion loops (FIG. 5A). The size and shape of the unfilled density fits the chemical structure of the HCMV fusion inhibitor, N-{4-[({(1S)-1-[3,5-bis(trifluoromethyl)phenyl]ethyl}carbamothioyl)amino]phenyl}-1,3-thiazole-4-carboxamide (FIG. 5D), which had been present throughout the production of the sample studied by electron cryomicroscopy (FIG. 5B). The compound adopted a pose with a kink between the trifluoromethyl phenyl moiety and the rest of the compound. The thiazole forms contacts with hydrophobic residues of L712, A738 and Y153, Y155 from an adjacent protomer. The phenyl is surrounded in a hydrophobic environment formed by residues of L715, the aliphatic hydrocarbon of D714 from domain V, G734 and I 730 from MPR, and F752 from the TM domain of an adjacent protomer. The trifluoromethyl phenyl resides in a hydrophobic environment near the hinge between MPR and TM helixes from another protomer. It may act as a hook to prevent the outward movement of MPR and TM domains. In addition to the interaction coordinated by the inhibitor compound, the W240, Y242 from other fusion loop are forming van der waals interactions with the hydrophobic patch from the MPR region and L715 in domain V respectively. (FIG. 5C). These specific interactions around the fusion inhibitor would be expected to hold domain I, domain V, and the MPR together and restrict movements among domain I, domain V, and the MPR during the fusion process (FIG. 6).

The effects of cross linking on the stability of the prefusion conformation were also tested. During the sample preparation steps, $BS^2G$ cross linking reagents either were or were not added. In the absence of the cross linker, the ratio of particles in prefusion versus postfusion conformations was 1:100, while the ratio was 1:4 in the sample that had been cross linked by the $BS^2G$ reagent. The cross linker was not identified in the electron density.

Example 3

Expression and Purification of gB1666

For the production of gB1666, the PSB1666 construct was transiently transfected into Expi293F cells. The cell pellets were harvested 96 hours after transfection. The PSB1666 protein was purified in 25 mM HEPES pH 7.5, 250 mM NaCl, 0.02% DDM, 0.002% CHS, 3 µg/ml WAY-174865 (inhibitor, see FIG. 5D) through a series or processes of solubilization, affinity column and size exclusion chromatography. The protein was analyzed on SDS-PAGE and by EM with negative staining to ensure at least 50% of the proteins displaying prefusion conformation. The PSB1666 protein is expressed efficiently in transfection of Expi293F cells and 1 L expression would generate ~0.1 mg of purified PSB1666 in high quality.

The polypeptide gB1666 (PSB1666)(SEQ ID NO: 57) includes a mutation in Domain I and IV. The polypeptide includes the following mutations, D217C and Y589C, relative to the corresponding wild-type gB.

Example 4

DNA-expressed gB1666 is Immunogenic in Balb/c Mice

One of the proposed stabilized full length prefusion gB constructs, gB1666 (SEQ ID NO: 57), has been shown by EM to have an increased proportion of molecules in the prefusion conformation relative to wild type gB of the Towne strain after purification from transfected mammalian cells in the presence of a fusion inhibitor (WAY-174865; see FIG. 5D). To assess whether this molecule can elicit immune responses in vivo, the DNA sequence corresponding to gB1666 and wild type gB were cloned into an in-house mammalian expression vector. Ten Balb/c mice were electroporated with 100 ug of DNA encoding gB1666 twice at a three-week interval (D0 and D21). An additional 10 mice were electroporated by the same protocol with DNA encoding wild type gB, and a third group was electroporated with a placebo, consisting of phosphate-buffered saline. Serum samples were collected at Day 28. ELISA was performed against recombinant gB protein produced from mammalian cells, based on the wild type sequence of Towne strain but with the transmembrane domain removed (Sino Biologicals) to determine the anti-gB IgG responses according to a standard protocol. Ten out of ten animals from the wild type gB DNA immunized mice and nine of ten gB1666 DNA immunized mice generated detectable anti-gB IgG titers (FIG. 11, showing mean±SD, LLOQ=25). The study demonstrates that gB1666 is immunogenic in Balb/c mice.

Example 5

Immunogenicity Study of Stabilized Prefusion gB1666 Protein

Immunogenicity study of gB1666 in mice. To evaluate the antibody response in mice, the following immunization scheme will be followed. At week 8, mice will be exsanguinated and the neutralization titers from the immunized animal serum will be determined and compared with those immunized with gB705 (postfusion) and/or gB wild type proteins.

TABLE 1

Mouse immunogenicity study design with gB1666 protein

| Group | No. of Mice | Immunogen | Adjuvant | Route | Dosing Schedule |
|---|---|---|---|---|---|
| 1 | 10 | gB705 (postfusion) (1.25 mcg/0.2 ml) | — | 0.2 ml/SC | Weeks 0, 3, 6 |
| 2 | 10 | gB705 (postfusion) (0.25 mcg/0.2 ml) | — | 0.2 ml/SC | Weeks 0, 3, 6 |
| 3 | 10 | gB1666 (in inhibitor-containing buffer) (1.25 mcg/0.2 ml) | — | 0.2 ml/SC | Weeks 0, 3, 6 |
| 4 | 10 | gB1666 (in inhibitor-containing buffer) (0.25 mcg/0.2 ml) | — | 0.2 ml/SC | Weeks 0, 3, 6 |
| 5 | 10 | gB wt (in inhibitor-containing buffer) (1.25 mcg/0.2 ml) | — | 0.2 ml/SC | Weeks 0, 3, 6 |
| 6 | 10 | gB wt (in inhibitor-containing buffer) (0.25 mcg/0.2 ml) | — | 0.2 ml/SC | Weeks 0, 3, 6 |
| 7 | 5 | Buffer (+Inhibitor) | — | 0.2 ml/SC | Weeks 0, 3, 6 |
| 8 | 5 | Buffer only | — | 0.2 ml/SC | Weeks 0, 3, 6 |

Embodiments of the present invention are set out in the following numbered clauses:

C1. A polypeptide comprising at least one introduced amino acid mutation relative to the amino acid sequence of the wild-type HCMV glycoprotein B (gB), wherein the polypeptide comprises a conformation that is not an HCMV gB postfusion conformation.

C2. A polypeptide that binds to an HCMV gB prefusion-specific antibody.

C3. A polypeptide comprising at least one introduced amino acid mutation relative to the amino acid sequence of the wild-type HCMV glycoprotein B (gB), wherein the polypeptide is capable of binding to an HCMV gB prefusion-specific antibody.

C4. A polypeptide comprising at least one introduced amino acid mutation relative to the amino acid sequence of the wild-type HCMV glycoprotein B (gB), wherein the polypeptide is capable of binding to a bis(aryl)thiourea compound.

C5. The polypeptide according to clause C3, wherein the compound is N-{4-[({(1S)-1-[3,5-bis(trifluoromethyl)phenyl]ethyl}carbamothioyl)amino]phenyl}-1,3-thiazole-4-carboxamide.

C6. The polypeptide according to clause C1, wherein said polypeptide is characterized by structure coordinates comprising a root mean square deviation (RMSD) of conserved residue backbone atoms when superimposed on backbone atoms described by structural coordinates of Table 1.

C7. A polypeptide comprising at least one amino acid mutation relative to the amino acid sequence of the wild-type HCMV gB polypeptide, wherein the amino acid mutation comprises a cysteine substitution.

C8. A polypeptide comprising at least one amino acid mutation relative to the amino acid sequence of the wild-type HCMV gB polypeptide, wherein the amino acid mutation comprises a mutation that allows a disulfide bond to form.

C9. A polypeptide comprising at least one amino acid mutation relative to the amino acid sequence of the wild-type HCMV gB polypeptide, wherein the amino acid mutation comprises an electrostatic mutation.

C10. A polypeptide comprising at least one amino acid mutation relative to the amino acid sequence of the wild-type HCMV gB polypeptide, wherein the amino acid mutation comprises a phenylalanine substitution.

C11. A polypeptide comprising at least one amino acid mutation relative to the amino acid sequence of the wild-type HCMV gB polypeptide, wherein the amino acid mutation comprises a leucine substitution.

C12. A polypeptide comprising at least one amino acid mutation relative to the amino acid sequence of the wild-type HCMV gB polypeptide, wherein the mutation stabilizes prefusion conformation of the polypeptide, and wherein the polypeptide specifically binds to an HCMV gB prefusion-specific antibody.

C13. A polypeptide comprising a cysteine at any one of the amino acid positions listed in column (ii) of Table 2, as compared to SEQ ID NO: 1.

C14. A polypeptide comprising an amino acid substitution at any one of the amino acid positions listed in column (ii) of Table 2, as compared to SEQ ID NO: 1.

C15. A polypeptide comprising the mutations Q98C and 1653C according to the numbering of SEQ ID NO: 1.

C16. A polypeptide comprising the mutations T100C and S269C according to the numbering of SEQ ID NO: 1.

C17. A polypeptide comprising the mutations D217C and F584C according to the numbering of SEQ ID NO: 1.

C18. A polypeptide comprising the mutations Y242C and K710C according to the numbering of SEQ ID NO: 1.

C19. A polypeptide comprising the mutations Y242C and D714C according to the numbering of SEQ ID NO: 1.

C20. A polypeptide comprising the mutations S367C and L499C according to the numbering of SEQ ID NO: 1.

C21. A polypeptide comprising the mutations T372C and W506C according to the numbering of SEQ ID NO: 1.

C22. A polypeptide comprising the mutations S550C and D652C according to the numbering of SEQ ID NO: 1.

C23. A polypeptide comprising the mutations T608C and D679C according to the numbering of SEQ ID NO: 1.

C24. A polypeptide comprising the mutations K695C and K724C according to the numbering of SEQ ID NO: 1.

C25. A polypeptide comprising an amino acid sequence that is at least about 90% identical to the amino acid sequence set forth in any one of SEQ ID NOs: 1-43, wherein the polypeptide comprises a mutation as compared to SEQ ID NO: 1.

C26. The polypeptide according to any one of clauses C1-C25, wherein the polypeptide does not comprise a mutation at any one of the following positions: R562, P577, S587, Y588, G592, G595, L601/H605, C610, L612, P613, Y625, Y627, F632, and K633.

C27. The polypeptide according to any one of clauses C1-C26, wherein the polypeptide does not comprise the cytoplasmic tail of HCMV gB.

C28. The polypeptide according to any one of clauses C1-C26, wherein the polypeptide does not comprise the transmembrane region.

C29. The polypeptide according to any one of clauses C1-C26, wherein the polypeptide comprises the cytoplasmic tail of HCMV gB and does not comprise the transmembrane region.

C30. The polypeptide according to any one of clauses C1-C29, wherein the polypeptide does not contain an insect cell pattern of glycosylation.

C31. The polypeptide according to any one of clauses C1-C30, wherein the polypeptide exhibits improved solubility or stability, as compared to a native gB in a postfusion conformation.

C32. The polypeptide according to any one of clauses C1-C31, wherein the polypeptide is immunogenic.

C33. A nucleic acid encoding the polypeptide according to any one of clauses C1-C32.

C34. The nucleic acid according to clause C33, wherein the nucleic acid comprises a self-replicating RNA molecule.

C35. The nucleic acid according to clause C33, wherein the nucleic acid comprises a modified RNA molecule.

C36. A composition comprising a nucleic acid according to any one of clauses C33-C35.

C37. A composition comprising the polypeptide according to any one of clauses C1-C32, and further comprising a CMV antigen.

C38. The composition according to any one of clauses C36-C37, further comprising any one of the following polypeptides: gO, gH, gL, pUL128, pUL130, pUL131, and any combination thereof.

C39. A composition comprising the polypeptide according to any one of clauses C1-C32, and a diluent.

C40. A composition comprising the polypeptide according to any one of clauses C1-C32, and an adjuvant.

C41. The composition according to any one of clauses C36-C40, wherein the composition is immunogenic.

C42. The composition according to any one of clauses C36-C41, for use in eliciting an immune response against cytomegalovirus.

C43. A method of eliciting an immune response in a mammal, the method comprising administering to the mammal an effective amount of the polypeptide according to any one of clauses C1-C32.

C44. A method for reducing cytomegalovirus viral shedding in a mammal, the method comprising administering to the mammal an effective amount of the polypeptide according to any one of clauses C1-C32.

C45. A polypeptide comprising at least one amino acid mutation relative to the amino acid sequence of the wild-type HCMV gB, wherein the polypeptide comprises an amino acid sequence having at least 95% identity to the amino acid sequence set forth in any one of SEQ ID NOs: 1-43.

C46. A polypeptide comprising at least one amino acid mutation relative to the amino acid sequence of the wild-type HCMV gB, wherein the polypeptide comprises an amino acid sequence having at least 95% identity to the amino acid sequence set forth in any one of SEQ ID NOs: 1-106.

C47. A polypeptide comprising at least one amino acid mutation relative to the amino acid sequence of the wild-type HCMV gB, wherein the polypeptide comprises an amino acid sequence having at least 95% identity to the amino acid sequence set forth in any one of SEQ ID NOs: 47-106.

C48. A polypeptide comprising an amino acid sequence having at least 95% identity to the sequence set forth in SEQ ID NO: 57.

C49. A composition comprising at least one polynucleotide encoding an HCMV polypeptide selected from any one of gH, gL, UL128, UL130, and UL131; a polynucleotide encoding HCMV gB or a fragment thereof; a polynucleotide encoding pp65 or a fragment thereof; and a pharmaceutically acceptable carrier or dilent.

C50. A composition comprising at least one polynucleotide comprising a sequence having at least 95% identity to a sequence selected from any one of SEQ ID NOS: 141-210; a polynucleotide encoding a polypeptide comprising an amino acid sequence having at least 95% identity to the amino acid sequence set forth in any one of SEQ ID NOs: 1-106; and a pharmaceutically acceptable carrier or dilent.

C51. A composition comprising at least one polynucleotide comprising a sequence having at least 95% identity to a sequence selected from any one of SEQ ID NOS: 224-254; a polynucleotide encoding a polypeptide comprising an amino acid sequence selected from any one of the amino acid sequences set forth in any one of SEQ ID NOs: 1-106; and a pharmaceutically acceptable carrier or dilent.

C52. A composition comprising at least one polypeptide comprising an amino acid sequence having at least 95% identity to an amino acid sequence selected from any one of SEQ ID NOS: 211-223; a polypeptide comprising an amino acid sequence having at least 95% identity to the amino acid sequence set forth in any one of SEQ ID NOs: 1-106; and a pharmaceutically acceptable carrier or dilent.

C53. A polypeptide comprising at least one amino acid mutation relative to the amino acid sequence of the wild-type HCMV gB, wherein the polypeptide comprises the amino acid sequence set forth in any one of SEQ ID NOs: 1-43, wherein the polypeptide comprises a mutation as compared to SEQ ID NO: 1.

C54. A polypeptide comprising at least one amino acid mutation relative to the amino acid sequence of the wild-type HCMV gB, wherein the polypeptide comprises the amino acid sequence set forth in any one of SEQ ID NOs: 1-106, wherein the polypeptide comprises a mutation as compared to SEQ ID NO: 1.

C55. A polypeptide comprising at least one amino acid mutation relative to the amino acid sequence of the wild-type HCMV gB, wherein the polypeptide comprises the amino acid sequence set forth in any one of SEQ ID NOs: 47-106, wherein the polypeptide comprises a mutation as compared to SEQ ID NO: 1.

C56. A polypeptide comprising the sequence set forth in SEQ ID NO: 57.

C57. A composition comprising at least one polynucleotide encoding an HCMV polypeptide selected from any one of gH, gL, UL128, UL130, and UL131; a polynucleotide encoding HCMV gB or a fragment thereof; a polynucleotide encoding pp65 or a fragment thereof; and a pharmaceutically acceptable carrier or dilent.

C58. A composition comprising at least one polynucleotide comprising a sequence selected from any one of SEQ ID NOS: 141-210; a polynucleotide encoding a polypeptide comprising the amino acid sequence set forth in any one of SEQ ID NOs: 1-106; and a pharmaceutically acceptable carrier or dilent.

C59. A composition comprising at least one polynucleotide comprising a sequence selected from any one of SEQ ID NOS: 224-254; a polynucleotide encoding a polypeptide comprising the amino acid sequence set forth in any one of SEQ ID NOs: 1-106; and a pharmaceutically acceptable carrier or dilent.

C60. A composition comprising at least one polypeptide comprising a sequence selected from any one of SEQ ID NOS: 211-223; a polypeptide comprising the amino acid sequence set forth in any one of SEQ ID NOs: 1-106; and a pharmaceutically acceptable carrier or dilent.

C61. The composition according to any one of clause C49-051 and C57-059, wherein the polynucleotide is DNA.

C62. The composition according to any one of clause C49-051 and C57-059, wherein the polynucleotide is RNA.

C63. The composition according to any one of clause C49-051 and C57-059, wherein at least one polynucleotide comprises at least one chemical modification.

C64. The composition according to clause C61, wherein the chemical modification is selected from the group consisting of pseudouridine, N1-methylpseudouridine, N1-ethylpseudouridine, N1-ethylpseudouridine, 2-thiouridine, 4'-thiouridine, 5-methylcytosine, 2-thio-l-methyl-1-deaza-pseudouri dine, 2-thio-l-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-l-methyl-pseudouridine, 4-thio-pseudouridine, 5-aza-uridine, dihydropseudouridine, 5-methoxyuridine and 2'-0-methyl uridine.

C65. The composition according to any one of clause C49-051 and C57-059, wherein the composition is formulated within a cationic lipid nanoparticle.

C66. A composition comprising at least one polynucleotide comprising a sequence selected from any one of SEQ ID NO: 153, SEQ ID NO: 156, SEQ ID NO: 155, SEQ ID NO: 157, SEQ ID NO: 210, SEQ ID NO: 152, and SEQ ID NO: 158; a polynucleotide encoding a polypeptide comprising the amino acid sequence set forth in any one of SEQ ID NOs: 1-106; and a pharmaceutically acceptable carrier or dilent.

C67. A composition comprising at least one polypeptide comprising a sequence selected from any one of SEQ ID NO: 211, SEQ ID NO: 213, SEQ ID NO: 214, SEQ ID NO: 215, SEQ ID NO: 216, and SEQ ID NO: 217; a polypeptide comprising the amino acid sequence set forth in any one of SEQ ID NOs: 1-106; and a pharmaceutically acceptable carrier or dilent.

SEQUENCE LISTING (254 sequences)

SEQ ID NO: 1 - protein, 907 aa, Artificial Sequence
  Synthetic amino acid sequence: Original HCMV gB (Towne) sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 2 - protein, 907 aa, Artificial Sequence
  Synthetic amino acid sequence: gB-001 Q98C, G271C sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMACGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTCDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 3 - protein, 907 aa, Artificial Sequence
  Synthetic amino acid sequence: gB-002  Q98C, I653C sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMACGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDCDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 4 - protein, 907 aa, Artificial Sequence
  Synthetic amino acid sequence: gB-003 G99C, A267C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQCTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFCTSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 5 - protein, 907 aa, Artificial Sequence
  Synthetic amino acid sequence: gB-004 T100C, A267C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGCDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFCTSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 6 - protein, 907 aa, Artificial Sequence
  Synthetic amino acid sequence: gB-005 T100C, S269C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGCDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATCTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 7 - protein, 907 aa, Artificial Sequence
  Synthetic amino acid sequence: gB-006 T100C, L651C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGCDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIACDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 8 - protein, 907 aa, Artificial Sequence
  Synthetic amino acid sequence: gB-007 D217C, F584C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDCYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNCANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 9 - protein, 907 aa, Artificial Sequence
  Synthetic amino acid sequence: gB-008 Y218C, A585C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDCSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFCNSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 10 - protein, 907 aa, Artificial Sequence
  Synthetic amino acid sequence: gB-009 S219C, D654C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYCNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDICPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 11 - protein, 907 aa, Artificial Sequence
  Synthetic amino acid sequence: gB-010 N220C, D652C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSCTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALCIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 12 - protein, 907 aa, Artificial Sequence
  Synthetic amino acid sequence: gB-011 T221C, D652C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNCHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALCIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 13 - protein, 907 aa, Artificial Sequence
  Synthetic amino acid sequence: gB-012 W240C, G718C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTCLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSCLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 14 - protein, 907 aa, Artificial Sequence
  Synthetic amino acid sequence: gB-013 Y242C, K710C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLCRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLCGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 15 - protein, 907 aa, Artificial Sequence
  Synthetic amino acid sequence: gB-014 Y242C, D714C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLCRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDCLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 16 - protein, 907 aa, Artificial Sequence
  Synthetic amino acid sequence: gB-015 S269C, I653C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATCTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDCDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 17 - protein, 907 aa, Artificial Sequence
  Synthetic amino acid sequence: gB-016 G271C, P614C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTCDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLCSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 18 - protein, 907 aa, Artificial Sequence
  Synthetic amino acid sequence: gB-017 S367C, L499C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFCSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRACAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 19 - protein, 907 aa, Artificial Sequence
  Synthetic amino acid sequence: gB-018 T372C, W506C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMCATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEACCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 20 - protein, 907 aa, Artificial Sequence
  Synthetic amino acid sequence: gB-019 F541C, Q669C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARCMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSCKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 21 - protein, 907 aa, Artificial Sequence
  Synthetic amino acid sequence: gB-020 L548C, A650C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGCASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMICLDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 22 - protein, 907 aa, Artificial Sequence
  Synthetic amino acid sequence: gB-021 A549C, I653C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLCSCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDCDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 23 - protein, 907 aa, Artificial Sequence
  Synthetic amino acid sequence: gB-022 S550C, D652C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLACCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALCIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 24 - protein, 907 aa, Artificial Sequence
  Synthetic amino acid sequence: gB-023 G604C, F661C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLCNHRTEECQLPSLKIFIAGNSAYEYVDYLFKRMIDLSSISTVDSMIALDIDPLENTDCRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 25 - protein, 907 aa, Artificial Sequence
  Synthetic amino acid sequence: gB-024 N605C, E665C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGCHRTEECQLPSLKIFIAGNSAYEYVDYLFKRMIDLSSISTVDSMIALDIDPLENTDFRVLCLYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 26 - protein, 907 aa, Artificial Sequence
  Synthetic amino acid sequence: gB-025 R607C, S675C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHCTEECQLPSLKIFIAGNSAYEYVDYLFKRMIDLSSISTVDSMIALDIDPLENTDFRVLELYSQKELRSCNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 27 - protein, 907 aa, Artificial Sequence
  Synthetic amino acid sequence: gB-026 T608C, D679C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRCEECQLPSLKIFIAGNSAYEYVDYLFKRMIDLSSISTVDSMIALDIDPLENTDFRVLELYSQKELRSSNVFCLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 28 - protein, 907 aa, Artificial Sequence
  Synthetic amino acid sequence: gB-027 E609C, F678C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTCECQLPSLKIFIAGNSAYEYVDYLFKRMIDLSSISTVDSMIALDIDPLENTDFRVLELYSQKELRSSNVCDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 29 - protein, 907 aa, Artificial Sequence
  Synthetic amino acid sequence: gB-028 R673C, S674C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELCCSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 30 - protein, 907 aa, Artificial Sequence
  Synthetic amino acid sequence: gB-029 N676C, V677C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSCCFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 31 - protein, 907 aa, Artificial Sequence
  Synthetic amino acid sequence: gB-030 L680C, E681C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDCCEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 32 - protein, 907 aa, Artificial Sequence
  Synthetic amino acid sequence: gB-031 I683C, M684C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEECCREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 33 - protein, 907 aa, Artificial Sequence
  Synthetic amino acid sequence: gB-032 F687C, N688C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMRECCSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 34 - protein, 907 aa, Artificial Sequence
  Synthetic amino acid sequence: gB-033 Y690C, K691C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSCCQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 35 - protein, 907 aa, Artificial Sequence
  Synthetic amino acid sequence: gB-034 K695C, K724C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVCYVEDKVVDPLPPYLKGLDDLMSGLGAAGCAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 36 - protein, 907 aa, Artificial Sequence
  Synthetic amino acid sequence: gB-035 T746C, F747C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVACCLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 37 - protein, 907 aa, Artificial Sequence
  Synthetic amino acid sequence: gB-036 K749C, N750C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLCCPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 38 - protein, 907 aa, Artificial Sequence
  Synthetic amino acid sequence: gB-037 K670L
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQLELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 39 - protein, 907 aa, Artificial Sequence
  Synthetic amino acid sequence: gB-038 K670F
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQFELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 40 - protein, 907 aa, Artificial Sequence
  Synthetic amino acid sequence: gB-039 R673L
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELLSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 41 - protein, 907 aa, Artificial Sequence
  Synthetic amino acid sequence: gB-040 R673F
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELFSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 42 - protein, 907 aa, Artificial Sequence
  Synthetic amino acid sequence: gB-041 K691L
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYLQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 43 - protein, 907 aa, Artificial Sequence
  Synthetic amino acid sequence: gB-042 K691F
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYFQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 44 - protein, 630 aa, Human cytomegalovirus
YGDVVGVNTTKYPYRVCSMAQGTDLIRFERNIICTSMKPINEDLDEGIMVVYKRNIVAHTFKVRVYQKVLTFRRSYAGHRTTYLLGSNTEYVAPPMWEIHHINKFAQCYSSYSRVIGGTVFVAYHRDSHENKTMQLIPDDYSNTHSTRYVTVKDQWHSRGSTATHRETCNLNCMLTITTARSKYPYHFFATSTGDVVYISPFYNGTNRNASYFGENADKFFIFPNYTIVSDFGRPNAAPETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETSGGLVVFWQGIKQKSLVELERLANRSSLNITHDDDDKSTSDNNTTHLSSMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPP

SEQ ID NO: 45 - protein, 705 aa, Artificial Sequence
  Synthetic sequence: gB705
MESRIWCLVVCVNLCIVCLGAVVSSSSTSHATSSAHNGSHTSRTTSAQTRSVSSQHVTSSEAVSHRANETIYNTTLKYGDVVGVNTTKYPYRVCSMAQGTDLIRFERNIVCTPMKPINEDLDEGIMVVYKRNIVAHTFKVRVYQKVLTFRRSYAGHRTTYLLGSNTEYVAPPMWEIHHINRHSQCYSSYSRVIAGTVFVAYHRDSYENKTMQLMLDDYSNTHSTRYVTVKDQWHSRGSTALYRETCNLNCMVTITTARSKYPYHFFATSTGDVVDISPFYNGTNRNTSYFGENADKFFIFPNYTIVSDFGRANSAPETHRLVAFLERADSVISWDIQDEKNVTCQLTFWEASERTIRSEAEDSYHFSSAKMTATFLSKKQEVNMSDPVLDCVRDQALNKLQQIFNASYNQTYEKYGNVSVFETTGGLVVFWQGIKQKSLLELERLANSSGVNSTRATKASTGNTTTLSLESESVRNVLYAQLQFTYDTLRSYINRALAQIAEAWCVDQRRTLEVFKELSKINPSAILSAIYNKPIAARFMGDVLGLASCVTINQTSVKVLRDMNVKESPGRCYSRPVVIFNFVNSSYVQYGQLGEDNEILLGNHRTEECQFPSLKIFIAGNSAYEYVDYLFKRMIDLSSISTVDSMIALDIDPLENTDFRVLELYSQKELRSSNVFDLEEIMREFNSYKQRVKYVEDKVVDPLPP

SEQ ID NO: 46 - protein, 907 aa, Human cytomegalovirus
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGRTGTQDKGQKPNLLDRLRHRKNGYRHLKDSDEEENV

SEQ ID NO: 47 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSCAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTCFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 48 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMACGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLECTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 49 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGCDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTACSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 50 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGCDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPCENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 51 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGCDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLECTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 52 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPCNEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNCSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 53 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPCNEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTCYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 54 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSCAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGCDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 55 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLCGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLCSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 56 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDCYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANCSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 57 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDCYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSCVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 58 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYCNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNCANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 59 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYCNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFCNSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 60 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYCNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFACSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 61 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSCTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENCDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 62 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHCTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENCDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 63 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTCLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGCVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 64 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTCLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGCAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 65 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLCRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGCAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 66 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLCRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAICAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 67 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTACSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPCENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 68 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATCTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPCENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 69 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATCTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLECTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 70 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGCVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLCSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 71 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDCVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYCDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 72 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFCEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMICLDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 73 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFCSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALCQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 74 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFCSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQICEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 75 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSACMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALACIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 76 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSCINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEECMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 77 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKCNPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEECMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 78 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKCNPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEICREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 79 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKICPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEICREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 80 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINCSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLCEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 81 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAACFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDCEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 82 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARCMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDCEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 83 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGCASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDCLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 84 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLCSCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLECTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 85 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLACCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDCLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 86 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLACCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLCNTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 87 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVCYGQLGEDNEILLGNHRTEECQLPSLKIFIAGNSAYEYVDYLFKRMIDLSSISTVDSMIALDIDPLENTDFRVLELYCQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 88 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILCGNHRTEECQLPSLKIFIAGNSAYEYVDYLFKRMIDLSSISTVDSMIALDIDPLENTDFRVLELCSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 89 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLCNHRTEECQLPSLKIFIAGNSAYEYVDYLFKRMIDLSSISTVDSMIALDIDPLENTDFRVLELYSQKECRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 90 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHCTEECQLPSLKIFIAGNSAYEYVDYLFKRMIDLSSISTVDSMIALDIDPLENTDFRVLELYSQKELRSSNVFDLEEIMREFCSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 91 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRCEECQLPSLKIFIAGNSAYEYVDYLFKRMIDLSSISTVDSMIALDIDPLENTDFRVLELYSQKELRSSNVFDLEEIMREFNSYKCRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 92 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTCECQLPSLKIFIAGNSAYEYVDYLFKRMIDLSSISTVDSMIALDIDPLENTDFRVLELYSQKELRSSNVFDLEEIMREFNSYCQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 93 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTECCQLPSLKIFIAGNSAYEYVDYLFKRMIDLSSISTVDSMIALDIDPLENTDFRVLELYSQKELRCSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 94 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTECCQLPSLKIFIAGNSAYEYVDYLFKRMIDLSSISTVDSMIALDIDPLENTDFRVLELYSQKELRSCNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 95 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECCLPSLKIFIAGNSAYEYVDYLFKRMIDLSSISTVDSMIALDIDPLENTDFRCLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 96 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGACASVVEGVATFLKNPFGACTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 97 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVCEGVATFLKNPFGCFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 98 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVCEGVATFLKNPFGACTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 99 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFSLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 100 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFNLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 101 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLESIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 102 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEQIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 103 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMRSFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 104 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMRQFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 105 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPIPEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 106 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVPSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 107 - protein, 630 aa, Artificial Sequence; identical to SEQ ID NO: 44
  >5CXF:A|PDBID|CHAIN|SEQUENCE

SEQ ID NO: 108 - protein, 630 aa, Artificial Sequence; identical to SEQ ID NO: 44
  >5CXF:B|PDBID|CHAIN|SEQUENCE

SEQ ID NO: 109 - protein, 630 aa, Artificial Sequence; identical to SEQ ID NO: 44
  >5CXF:C|PDBID|CHAIN|SEQUENCE

SEQ ID NO: 110 - protein, 905 aa, Human cytomegalovirus
MESRIWCLVVCVNLCIVCLGAAVSSSSTSHATSSAHNGSHTSRTTSAQTRSVSSQHVTSSEAVSHRANETIYNTTLKYGDVVGVNTTKYPYRVCSMAQGTDLIRFERNIVCTPMKPINEDLDEGIMVVYKRNIVAHTFKVRVYQKVLTFRRSYAYIHTTYLLGSNTEYVAPPMWEIHHINRHSQCYSSYSRVIAGTVFVAYHRDSYENKTMQLMLDDYSNTHSTRYVTVKDQWHSRGSTWLYRETCNLNCMVTITTARSKYPYHFFATSTGDVVDISPFYNGTNRNTSYFGENADKFFIFPNYTIVSDFGRANSAPETHRLVAFLERADSVISWDIQDEKNVTCQLTFWEASERTIRSEAEDSYHFSSAKMTATFLSKKQEVNMSDPVLDCVRDQALNKLQQIFNASYNQTYEKYGNVSVFETTGGLVVFWQGIKQKSLLELERLANSSGVNSTRRTKRSTGNTTTLSLESESVRNVLYAQLQFTYDTLRSYINRALAQIAEAWCVDQRRTLEVFKELSKINPSAILSAIYNKPIAARFMGDVLGLASCVTINQTSVKVLRDMNVKESPGRCYSRPVVIFNFVNSSYVQYGQLGEDNEILLGNHRTEECQFPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 111 - protein, 905 aa, Human cytomegalovirus
MESRIWCLVVCVNLCIVCLGAVVSSSSTSHATSSAHNGSHTSRTTSAQTRSVSSQHVTSSEAVSHRANETIYNTTLKYGDVVGVNTTKYPYRVCSMAQGTDLIRFERNIVCTPMKPINEDLDEGIMVVYKRNIVAHTFKVRVYQKVLTFRRSYAYIHTTYLLGSNTEYVAPPMWEIHHINRHSQCYSSYSRVIAGTVFVAYHRDSYENKTMQLMLDDYSNTHSTRYVTVKDQWHSRGSTWLYRETCNLNCMVTITTARSKYPYHFFATSTGDVVDISPFYNGTNRNTSYFGENADKFFIFPNYTIVSDFGRANSAPETHRLVAFLERADSVISWDIQDEKNVTCQLTFWEASERTIRSEAEDSYHFSSAKMTATFLSKKQEVNMSDPVLDCVRDQALNKLQQIFNASYNQTYEKYGNVSVFETTGGLVVFWQGIKQKSLLELERLANSSGVNSTRRTKRSTGNTTTLSLESESVRNVLYAQLQFTYDTLRSYINRALAQIAEAWCVDQRRTLEVFKELSKINPSAILSAIYNKPIAARFMGDVLGLASCVTINQTSVKVLRDMNVKESPGRCYSRPVVIFNFVNSSYVQYGQLGEDNEILLGNHRTEECQFPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 112 - protein, 905 aa, Human cytomegalovirus
MESRIWCLVVCVNLCIVCLGAVVSSSSTSHATSSAHNGSHTSRTTSAQTRSVSSQHVTSSEAVSHRANETIYNTTLKYGDVVGVNTTKYPYRVCSMAQGTDLIRFERNIVCTPMKPINEDLDEGIMVVYKRNIVAHTFKVRVYQKVLTFRRSYAYIHTTYLLGSNTEYVAPPMWEIHHINRHSQCYSSYSRVIAGTVFVAYHRDSYENKTMQLMLDDYSNTHSTRYVTVKDQWHSRGSTWLYRETCNLNCMVTITTARSKYPYHFFATSTGDVVDISPFYNGTNRNTSYFGENADKFFIFPNYTIVSDFGRANSAPETHRLVAFLERADSVISWDIQDEKNVTCQLTFWEASERTIRSEAEDSYHFSSAKMTATFLSKKQEVNMSDPVLDCVRDQALNKLQQIFNASYNQTYEKYGNVSVFETTGGLVVFWQGIKQKSLLELERLANSSGVNSTRRTKRSTGNTTTLSLESESVRNVLYAQLQFTYDTLRSYINRALAQIAEAWCVDQRRTLEVFKELSKINPSAILSAIYNKPIAARFMGDVLGLASCVTINQTSVKVLRDMNVKESPGRCYSRPVVIFNFVNSSYVQYGQLGEDNEILLGNHRTEECQFPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGSTKDTSLQAPPSYEESVYNSGRKGPGPPSSDASTAAPPYTNEQAYQMLLALARLDAEQRAQQNGTDSLDGRTGTQDKGQKPNLLDRLRHRKNGYRHLKDSDEEENV

SEQ ID NO: 113 - protein, 905 aa, Human cytomegalovirus
MESRIWCLVVCVNLCYVCLGAVVSSSSTSHATSSAHNGSHTSRTTSAQTRSVSSQHVTSSEAVSHRANETIYNTTLKYGDVVGVNTTKYPYRVCSMAQGTDLIRFERNIVCTPMKPINEDLDEGIMVVYKRNIVAHTFKVRVYQKVLTFRRSYAYIHTTYLLGSNTEYVAPPMWEIHHINRHSQCYSSYSRVIAGTVFVAYHRDSYENKTMQLMLDDYSNTHSTRYVTVKDQWHSRGSTWLYRETCNLNCMVTITTARSKYPYHFFATSTGDVVDISPFYNGTNRNTSYFGENADKFFIFPNYTIVSDFGRANSAPETHRLVAFLERADSVISWDIQDEKNVTCQLTFWEASERTIRSEAEDSYHFSSAKMTATFLSKKQEVNMSDPVLDCVRDQALNKLQQIFNASYNQTYEKYGNVSVFETTGGLVVFWQGIKQKSLLELERLANSSGVNSTRRTKRSTGNTTTLSLESESVRNVLYAQLQFTYDTLRSYINRALAQIAEAWCVDQRRTLEVFKELSKINPSAILSAIYNKPIAARFMGDVLGLASCVTINQTSVKVLRDMNVKESPGRCYSRPVVIFNFVNSSYVQYGQLGEDNEILLGNHRTEECQFPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 114 - protein, 905 aa, Human cytomegalovirus
MESRIWCLVVCVNLCIVCLGVAVSSSSTSHATSSAHNGSHTSRTTSAQTRSVSSQHVTSSEAVSHRANETIYNTTLKYGDVVGVNTTKYPYRVCSMAQGTDLIRFERNIVCTPMKPINEDLDEGIMVVYKRNIVAHTFKVRVYQKVLTFRRSYAYIHTTYLLGSNTEYVAPPMWEIHHINRHSQCYSSYSRVIAGTVFVAYHRDSYENKTMQLMLDDYSNTHSTRYVTVKDQWHSRGSTWLYRETCNLNCMVTITTARSKYPYHFFATSTGDVVDISPFYNGTNRNTSYFGENADKFFIFPNYTIVSDFGRANSAPETHRLVAFLERADSVISWDIQDEKNVTCQLTFWEASERTIRSEAEDSYHFSSAKMTATFLSKKQEVNMSDPVLDCVRDQALNKLQQIFNASYNQTYEKYGNVSVFETTGGLVVFWQGIKQKSLLELERLANSSGVNSTRRTKRSTGNTTTLSLESESVRNVLYAQLQFTYDTLRSYINRALAQIAEAWCVDQRRTLEVFKELSKINPSAILSAIYNKPIAARFMGDVLGLASCVTINQTSVKVLRDMNVKESPGRCYSRPVVIFNFVNSSYVQYGQLGEDNEILLGNHRTEECQFPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 115 - protein, 905 aa, Human cytomegalovirus
MESRIWCLVVCVNLCIVCLGAAVSSSSTSHATSSTHNGSHTSRTTSAQTRSVSSQHVTSSEAVSHRANETIYNTTLKYGDVVGVNTTKYPYRVCSMAQGTDLIRFERNIVCTPMKPINEDLDEGIMVVYKRNIVAHTFKVRVYQKVLTFRRSYAYIHTTYLLGSNTEYVAPPMWEIHHINRNSQCYSSYSRVIAGTVFVAYHRDSYENKTMQLMLDDYSNTHSTRYVTVKDQWHSRGSTWLYRETCNLNCMVTITTARSKYPYHFFATSTGDVVDISPFYNGTNRNTSYFGENADKFFIFPNYTIVSDFGRANSAPETHRLVAFLERADSVISWDIQDEKNVTCQLTFWEASERTIRSEAEDSYHFSSAKMTATFLSKKQEVNMSDPVLDCVRDQALNKLQQIFNASYNQTYEKYGNVSVFETTGGLVVFWQGIKQKSLLELERLANSSGVNSTRRTKRSTGNTTTLSLESESVRNVLYAQLQFTYDTLRSYINRALAQIAEAWCVDQRRTLEVFRELSKINPSAILSAIYNKPIAARFMGDVLGLASCVTINQTSVKVLRDMNVKESPGRCYSRPVVIFNFVNSSYVQYGQLGEDNEILLGNHRTEECQFPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 116 - protein, 905 aa, Human cytomegalovirus
MESRIWCLVVCVNLCIVCLGAAVSSSSTSHATSSTHNGSHASRTTSAQTRSVSSQHVTSSKAVSHRANETIYNTTLKYGDVVGVNTTKYPYRVCSMAQGTDLIRFERNIVCTPMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMLDDYSNTHSIRYVTVKDQWHSRGSTWLYRETCNLNCMVTITTARSKYPYHFFATSTGDVVDISPFYNGTNRNTSYFGENADKFFIFPNYTIVSDFGRANSAPETHRLVAFLERADSVISWDIQDEKNVTCQLTFWEASERTIRSEAEDSYHFSSAKMTATFLSKKQEVNMSDPVLDCVRNQALDKLQQIFNASYNQTYEKYGNVSVFETTGGLVVFWQGIKQKSLLELERLANSSGVNSTRRTKRSTGNTTTLSPESESVRNVLYAQLQFTYDTLRSYINRALAQIAEAWCVDQRRTLEVFKELSKINPSAILSAIYNKPIAARFMGDVLGLASCVTINQTSVKVLRDMNVKESPGRCYSRPVVIFNFVNSSYVQYGQLGEDNEILLGNHRTEECQFPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 117 - protein, 904 aa, Human cytomegalovirus
MESRIWCLVVCVNLCIVCLGAAVSSSSTRGTSATHNGSHTSHTTSAQTRSVSSQHVTSSEAVSHRANETIYNTTLKYGDVVGVNTTKYPYRVCSMAQGTDLIRFERNIVCTPMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMLDDYSNTHSTRYVTVKDQWHSRGSTWLYRETCNLNCMVTITTARSKYPYHFFATSTGDVVDISPFYNGTNRNTSYFGENADKFFIFPNYTIVSDFGRANSAPETHRLVAFLERADSVISWDIQDEKNVTCQLTFWEASERTIRSEAEDSYHFSSAKMTATFLSKKQEVNMSDPVLDCVRNQALNKLQQIFNASYNQTYEKYGNVSVFETTGGLVVFWQGIKQKSLLELERLANSSGVNSTRRTKRSTGNTTTLSLESESVRNVLYAQLQFTYDTLRSYINRALAQIAEAWCVDQRRTLEVFKELSKINPSAILSAIYNKPIAARFMGDVLGLASCVTINQTSVKVLRDMNVKESPGRCYSRPVVIFNFVNSSYVQYGQLGEDNEILLGNHRTEECQFPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSSSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 118 - protein, 906 aa, Human cytomegalovirus
MESRIWCLVVCVNLCIVCLGAAVSSSSTSHATSSTHNGSHTSRTTSAQTRSVYSQHVTSSEAVSHRANETIYNTTLKYGDVVGVNTTKYPYRVCSMAQGTDLIRFERNIICTSMKPINEDLDEGIMVVYKRNIVAHTFKVRVYQKVLTFRRSYAYIYTTYLLGSNTEYVAPPMWEIHHINKFAQCYSSYSRVIGGTVFVAYHRDSYENKTMQLIPDDYSNTHSTRYVTVKDQWHSRGSTWLYRETCNLNCMLTITTARSKYPYHFFATSTGDVVYISPFYNGTNRNASYFGENADKFFIFPNYTIVSDFGRPNAAPETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETSGGLVVFWQGIKQKSLVELERLANRSSLNITHRTRRSTSDNNTTHLSSMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 119 - protein, 906 aa, Human cytomegalovirus
MESRIWCLVVCVNLCIVCLGAAVSSSSTSHATSSTHNGSHTSRTTSAQTRSVYSQHVTSSEAVSHRANETIYNTTLKYGDVVGVNTTKYPYRVCSMAQGTDLIRFERNIICTSMKPINEDLDEGIMVVYKRNIVAHTFKVRVYQKVLTFRRSYAYIYTTYLLGSNTEYVAPPMWEIHHINKFAQCYSSYSRVIGGTVFVAYHRDSYENKTMQLIPDDYSNTHSTRYVTVKDQWHSRGSTWLYRETCNLNCMLTITTARSKYPYHFFATSTGDVVDISPFYNGTNRNASYFGENADKFFIFPNYTIVSDFGRPNAAPETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETSGGLVVFWQGIKQKSLVELERLANRSSLNITHRTRRSTSDNNTTHLSSMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 120 - protein, 906 aa, Human cytomegalovirus
MESRIWCLVVCVNLCIVCLGAAVSSSSTSHATSSTHNGSHTSRTTSAQTRSVYSQHVTSSEAVSHRANETIYNTTLKYGDVVGVNTTKYPYRVCSMAQGTDLIRFERNIICTSMKPINEDLDEGIMVVYKRNIVAHTFKVRVYQKVLTFRRSYAYIYTTYLLGSNTEYVAPPMWEIHHINKFAQCYSSYSRVIGGTVFVAYHRDSYENKTMQLIPDDYSNTHSTRYVTVKDQWHSRGSTWLYRETCNLNCMLTITTARSKYPYHFFATSTGDVVDISPFYNGTNRNASYFGENADKFFIFPNYTIVSDFGRPNAAPETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETSGGLVVFWQGIKQKSLVELERLANRSSLNITHRTRRSTSDNNTTHLSSMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQAGTQDKGQKPNLLDRLRHRKNGYRHLKDSDEEENV

SEQ ID NO: 121 - protein, 906 aa, Human cytomegalovirus
MESRIWCLVVCVNLCIVCLGAAVSSSSTSHATSSTHNGSHTSRTTSAQTRSVSSQHVTSSEAVSHRANETIYNTTLKYGDVVGVNTTKYPYRVCSMAQGTDLIRFERNIVCTPMKPINEDLDEGIMVVYKRNIVAHTFKVRVYQKVLTFRRSYAYIHTTYLLGSNTEYVAPPMWEIHHINKFAQCYSSYSRVIGGTVFVAYHRDSYENKTMQLMSDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNAAPETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETSGGLVVFWQGIKQKSLVELERLANRSSLNITHRTRRSTSDNNTTHLSSMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 122 - protein, 906 aa, Human cytomegalovirus
MESRIWCLVVCVNLCIVCLGAAVSSSSTSHATSSTHNGSHTSRTTSAQTRSVSSQHVTSSEAVSHRANETIYNTTLKYGDVVGVNTTKYPYRVCSMAQGTDLIRFERNIVCTPMKPINEDLDEGIMVVYKRNIVAHTFKVRVYQKVLTFRRSYAYIHTTYLLGSNTEYVAPPMWEIHHINKFAQCYSSYSRVIGGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNAAPETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETSGGLVVFWQGIKQKSLVELERLANRSSLNITHRTRRSTSDNNTTHLSSMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 123 - protein, 907 aa, Human cytomegalovirus
MESRIWCLVVCVNLCIVCLGAAVSSSSTHGTSATHSHHSSHTTSAAHSRSGSVSSQRVTSSEAVSHRANETIYNTTLKYGDVVGVNTTKYPYRVCSMAQGTDLIRFERNIVCTPMKPINEDLDEGIMVVYKRNIVAHTFKVRVYQKVLTFRRSYAYIYTTYLLGSNTEYVAPPMWEIHHINKFAQCYSSYSRVIGGTVFVAYHRDSYENKTMQLIPDDYSNTHSTRYVTVKDQWHSRGSTWLYRETCNLNCMLTITTARSKYPYHFFATSTGDVVDISPFYNGTNRNASYFGENADKFFIFPNYTIVSDFGRPNAAPETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETSGGLVVFWQGIKQKSLVELERLANRSSLNITHRTRRSTSDNNTTHLSSMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 124 - protein, 907 aa, Human cytomegalovirus
MESRIWCLVVCVNLCIVCLGAAVSSSSTHGTSATHSHHSSHTTSAAHSRSGSVSSQRVTSSEAVSHRANETIYNTTLKYGDVVGVNTTKYPYRVCSMAQGTDLIRFERNIVCTPMKPINEDLDEGIMVVYKRNIVAHTFKVRVYQKVLTFRRSYAYIYTTYLLGSNTEYVAPPMWEIHHINKFAQCYSSYSRVIGGTVFVAYHRDSYENKTMQLIPDDYSNTHSTRYVTVKDQWHSRGSTWLYRETCNLNCMLTITTARSKYPYHFFATSTGDVVDISPFYNGTNRNASYFGENADKFFIFPNYTIVSDFGRPNAAPETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETSGGLVVFWQGIKQKSLVELERLANRSSLNITHRTRRSTSDNNTTHLSSMESVHNLVYAQLQFTYDTLRGYINRALAQIAEAWCVDQRRTLEVFKKLSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 125 - protein, 906 aa, Human cytomegalovirus
MESRIWCLVVCVNLCIVCLGAAVSSSTSHATSSTHNGSHTSRTTSAQTRSVSSQHVTSSEAVSHRANETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRSVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTNGNNATHLSNMESVHNLVYAQLQFTYDTLRGYINRALAQIAEAWCVDQRRSLEVFRELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 126 - protein, 906 aa, Human cytomegalovirus
MESRIWCLVVCVNLCIVCLGAAVSSSTSHATSSTHNGSHTSRTTSAQTRSVSSQHVTSSEAVSHRANETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRSVAFLERAESVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTNGSNATHLSNMESVHNLVYAQLQFTYDTLRGYINRALAQIAEAWCVDQRRSLEVFRELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 127 - protein, 907 aa, Human cytomegalovirus
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 128 - protein, 907 aa, Human cytomegalovirus
MESRIWCLVVCVNLCIVRLGAAVSSSSTRGTSATHSHHSSRTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGNVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 129 - protein, 907 aa, Human cytomegalovirus; identical to SEQ ID NO: 46

SEQ ID NO: 130 - protein, 907 aa, Human cytomegalovirus
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTLGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 131 - protein, 907 aa, Human cytomegalovirus
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSVLDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 132 - protein, 908 aa, Human cytomegalovirus
MESRIWCLVVCVNLCIVCLGAAVSSSSTSRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHSRTKRSADGNNATHLSSMESVHNLVYAQLQFTYDTLRGYINRALAQIAEAWCVDQRRSLEVFKELSKINPSAILSAIYNKPIAARFMGDVLGLASCVTINQTSVKVLRDMNVKDSPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCMQPLQNLFPYLVSANGTTVTSGNTKDTSLQAPPSYEESVYNSGRKGSGPPSSDASTAAPPYTNEQAYQMLLALVRLDAEQRAQQNGTDSLDGQTGTQDKGQKPNLLDRLRHRKNGYRHLKDSDEEENV

SEQ ID NO: 133 - protein, 907 aa, Human cytomegalovirus
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEAPERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGRTGTQDKGQKPNLLDRLRHRKNGYRHLKDSDEEENV

SEQ ID NO: 134 - protein, 907 aa, Human cytomegalovirus
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRANSAPETHRLVAFLERADSVISWDIQDEKNVTCQLTFWEASERTIRSEAEDSYHFSSAKMTATFLSKKQEVNMSDSVLDCVRDEAINKLQQIFNTSYNQTYEKYGNVSVFETTGGLVVFWQGIKQKSLVELERLANRSSLNLTHSRAKRSADGNNTTHLSNMESVHNLVYAQLQFTYDTLRGYINRALAQIAEAWCVDQRRSLEVFRELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 135 - protein, 905 aa, Human cytomegalovirus
MESRIWCLVVCVNLCIVCLGAAVSSSTSRATSTHNGSHISRTTSAQTRSISSQRVTSSEAVSHRANETIYNTTLKYGDVVGVNTTKYPYRVCSMAQGTDLIRFDRNIVCTPMKPINEDLDEGIMVVYKRNIVAHTFKVRVYQKVLTFRRSYAYIHTTYLLGSNTEYVAPPMWEIHHINRHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEESYHFSSAKMTATFLSKKQEVNMSDSALDCVRDEALNKLQQIFNTSYNQTYEKYGNVSVFETTGGLVVFWQGIKQKSLVELERLANRSSLNLTHSRTRRSTDGTNVTHLSNMDSVHNLVYAQLQFTYDTLRGYINRALTQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 136 - protein, 905 aa, Human cytomegalovirus
MESRIWCLVVCVNLCIVCLGAAVSSSTSRATSTHNGNHTSHTTSAQTRSISSQRVTSSEAVSHRANETIYNTTLKYGDVVGVNTTKYPYRVCSMAQGTDLIRFDRNIVCTPMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEESYHFSSAKMTATFLSKKQEVNMSDSALDCVRDEALNKLQQIFNASYNQTYEKYGNVSVFETTGGLVVFWQGIKQKSLVELERLANRSSLNLTHSRTRRSTDGTNVTHLSNMDSVHNLVYAQLQFTYDTLRGYINRALTQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 137 - protein, 907 aa, Human cytomegalovirus; identical to SEQ ID NO: 1

SEQ ID NO: 138 - protein, 907 aa, Human cytomegalovirus
MESRIWCLVVCVNLCIVCLGAAVSSSSTRGTSSTHSHHSSHTTSAAHSRSGSVSQRVTSSQTVSHGVNETIYNTTLRYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSIDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 139 - protein, 907 aa, Human cytomegalovirus
MESRIWCLVVCVNLCIVCLGAAVSSSSTTGSRGTSTHNHHSSHTTSAARSQSGSVSHHVTSSQTVSHDVNETIYNTTLKYGDVVGVNTTKYPYRVCSMAQGTDLIRFERNIVCTPVKPINEDLDEGIMVVYKRNIVAHTFKVRVYQKVLTFRRSYAYIYSTYLLGSNTEYVAPPMWEIHHINKFAQCYSSYSRVIAGTLFVAYHRDSYENKTMQLMSDDYSNTHSTRYVTVKDQWHSRGSTWLYHETCNLNCMVTMTAARSKYPYHFFATSTGDVVDISPFYNGTNRNTSYFGENADKFFIFPNYTIVSDFGRPNAAQETHRLVAFLERADSVISWDIQDEKNVTCQLTFWEASERTIRSEAKDSYHFSSAKMTATFLSKKQEVNMSDPVLDCVRDQALNKLQQIFNASYNQTYEKYGNVSVFETTGGLVVFWQGIKQKSLLELERLANSSGVNATRRSKRSTNNTTTLSLENDSVRSVLYAQLQFTYDTLRNYINRALAQIAEAWCVDQRRTLEVFKELSKINPSAILSAIYNKPIAARFMGDVLGLASCVTINQTSVKVLRDMTIKDSTGRCYSRPVVIFTFANSSHVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 140 - protein, 907 aa, Human cytomegalovirus
MESRIWCLVVCVNLCIVCLGAAVSSSSTTGSRGTSTHNHHSSHTTSAARSQSGSVSHHVTSSQTVSHDVNETIYNTTLKYGDVVGVNTTKYPYRVCSMAQGTDLIRFERNIVCTPVKPINEDLDEGIMVVYKRNIVAHTFKVRVYQKVLTFRRSYAYIYSTYLLGSNTEYVAPPMWEIHHINKFAQCYSSYSRVIAGTLFVAYHRDSYENKTMQLMSDDYSNTHSTRYVTVKDQWHSRGSTWLYHETCNLNCMVTMTAARSKYPYHFFATSTGDVVDISPFYNGTNRNTSYFGENADKFFIFPNYTIVSDFGRPNAAQETHRLVAFLERADSVISWDIQDEKNVTCQLTFWEASERTIRSEAKDSYHFSSAKMTATFLSKKQEVNMSDPVLDCVRDQALNKLQQIFNASYNQTYEKYGNVSVFETTGGLVVFWQGIKQKSLLELERLANSSGVNATRRSKRSTNNTTTLSLENDSVRSVLYAQLQFTYDTLRNYINRALAQIAEAWCVDQRRTLEVFKELSKINPSAILSAIYNKPIAARFMGDVLGLASCVTINQTSVKVLRDMTIKDSTGRCYSRPVVIFTFANSSHVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAQPYTNEQAYQMLLALARLDAEQRAQQNGTDSLNGQTGTQDKGQKPNLLDRLRHRKNGYRHLKDSDEEENV

SEQ ID NO: 141 - DNA, 2437 bp, Artificial Sequence
  Synthetic polypeptide
tcaagcttttggaccctcgtacagaagctaatacgactcactatagggaaataagagagaaaagaagagtaagaagaaatataagagccaccatgcggccaggcctcccctcctacctcatcatcctcgccgtctgtctcttcagccacctactttcgtcacgatatggcgcagaagccgtatccgaaccgctggacaaagcgtttcacctactgctcaacacctacgggagacccatccgcttcctgcgtgaaaataccacccagtgtacctacaacagcagcctccgtaacagcacggtcgtcagggaaaacgccatcagtttcaacttcttccaaagctataatcaatactatgtattccatatgcctcgatgtctctttgcgggtcctctggcggagcagtttctgaaccaggtagatctgaccgaaaccctggaaagataccaacagagacttaacacttacgcgctggtatccaaagacctggccagctaccgatctttctcgcagcagctaaaggcacaagacagcctaggtgaacagcccaccactgtgccaccgcccattgacctgtcaatacctcacgtttggatgccaccgcaaaccactccacacggctggacagaatcacataccacctcaggactacaccgaccacactttaaccagacctgtatcctctttgatggacacgatctactattcagcaccgtcacaccttgtttgcaccaaggcttttacctcatcgacgaactacgttacgttaaaataacactgaccgaggacttcttcgtagttacggtgtccatagacgacgacacacccatgctgcttatcttcggccatcttccacgcgtacttttcaaagcgccctatcaacgcgacaactttatactacgacaaactgagaaacacgagctcctggtgctagttaagaaagatcaactgaaccgtcactcttatctcaaagacccggactttcttgacgccgcacttgacttcaactacctagacctcagcgcactactacgtaacagctttcaccgttacgccgtggatgtactcaagagcggtcgatgtcagatgctggaccgccgcacggtagaaatggccttcgcctacgcattagcactgttcgcagcagcccgacaagaagaggccggcgcccaagtctccgtcccacgggccctagaccgccaggccgcactcttacaaatacaagaatttatgatcacctgcctctcacaaacaccaccacgcaccacgttgctgctgtatcccacggccgtggacctggccaaacgagccctttggacaccgaatcagatcaccgacatcaccagcctcgtacgcctggtctacatactctctaaacagaatcagcaacatctcatcccccaatgggcactacgacagatcgccgactttgccctaaaactacacaaaacgcacctggcctcttttctttcagccttcgcacgccaagaactctacctcatgggcagcctcgtccactccatgctggtacatacgacggagagacgcgaaatcttcatcgtagaaacgggcctctgttcattggccgagctatcacactttacgcagttgttagctcatccacaccacgaatacctcagcgacctgtacacaccctgttccagtagcgggcgacgcgatcactcgctcgaacgcctcacgcgtctcttccccgatgccaccgtccccgctaccgttcccgccgccctctccatcctatctaccatgcaaccaagcacgctggaaaccttccccgacctgttttgcttgccgctcggcgaatccttctccgcgctgaccgtctccgaacacgtcagttatatcgtaacaaaccagtacctgatcaaaggtatctcctaccctgtctccaccaccgtcgtaggccagagcctcatcatcacccagacggacagtcaaactaaatgcgaactgacgcgcaacatgcataccacacacagcatcacagtggcgctcaacatttcgctagaaaactgcgccttttgccaaagcgccctgctagaatacgacgacacgcaaggcgtcatcaacatcatgtacatgcacgactcggacgacgtccttttcgccctggatccctacaacgaagtggtggtctcatctccgcgaactcactacctcatgcttttgaagaacggtacggtactagaagtaactgacgtcgtcgtggacgccaccgacagtcgtctcctcatgatgtccgtctacgcgctatcggccatcatcggcatctatctgctctaccgcatgctcaagacatgctgataataggctggagcctcggtggccatgcttcttgccccttgggcctccccccagcccctcctccccttcctgcacccgtacccccgtggtctttgaataaagtctgagtgggcggc

SEQ ID NO: 142 - DNA, 1045 bp, Artificial Sequence
  Synthetic polypeptide
tcaagcttttggaccctcgtacagaagctaatacgactcactatagggaaataagagagaaaagaagagtaagaagaaatataagagccaccatgtgccgccgcccggattgcggcttctctttctcacctggaccggtgatactgctgtggtgttgccttctgctgcccattgtttcctcagccgccgtcagcgtcgctcctaccgccgccgagaaagtccccgcggagtgccccgaactaacgcgccgatgcttgttgggtgaggtgtttgagggtgacaagtatgaaagttggctgcgcccgttggtgaatgttaccgggcgcgatggcccgctatcgcaacttatccgttaccgtcccgttacgccggaggccgccaactccgtgctgttggacgaggctttcctggacactctggccctgctgtacaacaatccggatcaattgcgggccctgctgacgctgttgagctcggacacagcgccgcgctggatgacggtgatgcgcggctacagcgagtgcggcgatggctcgccggccgtgtacacgtgcgtggacgacctgtgccgcggctacgacctcacgcgactgtcatacgggcgcagcatcttcacggaacacgtgttaggcttcgagctggtgccaccgtctctctttaacgtggtggtggccatacgcaacgaagccacgcgtaccaaccgcgccgtgcgtctgcccgtgagcaccgctgccgcgcccgagggcatcacgctcttttacggcctgtacaacgcagtgaaggaattctgcctgcgtcaccagctggacccgccgctgctacgccacctagataaatactacgccggactgccgcccgagctgaagcagacgcgcgtcaacctgccggctcactcgcgctatggccctcaagcagtggatgctcgctgataataggctggagcctcggtggccatgcttcttgccccttgggcctccccccagcccctcctccccttcctgcacccgtacccccgtggtctttgaataaagtctgagtgggcggc

SEQ ID NO: 143 - DNA, 724 bp, Artificial Sequence
  Synthetic polypeptide
tcaagcttttggaccctcgtacagaagctaatacgactcactatagggaaataagagagaaaagaagagtaagaagaaatataagagccaccatgagtcccaaagatctgacgccgttcttgacggcgttgtggctgctattgggtcacagccgcgtgccgcgggtgcgcgcagaagaatgttgcgaattcataaacgtcaaccacccgccggaacgctgttacgatttcaaaatgtgcaatcgcttcaccgtcgcgctgcggtgtccggacggcgaagtctgctacagtcccgagaaaacggctgagattcgcgggatcgtcaccaccatgacccattcattgacacgccaggtcgtacacaacaaactgacgagctgcaactacaatccgttatacctcgaagctgacgggcgaatacgctgcggcaaagtaaacgacaaggcgcagtacctgctgggcgccgctggcagcgttccctatcgatggatcaatctggaatacgacaagataacccggatcgtgggcctggatcagtacctggagagcgttaagaaacacaaacggctggatgtgtgccgcgctaaaatgggctatatgctgcagtgataataggctggagcctcggtggccatgcttcttgccccttgggcctccccccagcccctcctccccttcctgcacccgtacccccgtggtctttgaataaagtctgagtgggcggc

SEQ ID NO: 144 - DNA, 846 bp, Artificial Sequence
  Synthetic polypeptide
tcaagcttttggaccctcgtacagaagctaatacgactcactatagggaaataagagagaaaagaagagtaagaagaaatataagagccaccatgctgcggcttctgcttcgtcaccactttcactgcctgcttctgtgcgcggtttgggcaacgccctgtctggcgtctccgtggtcgacgctaacagcaaaccagaatccgtccccgccatggtctaaactgacgtattccaaaccgcatgacgcggcgacgttttactgtccttttctctatccctcgcccccacgatcccccttgcaattctcggggttccagcgggtatcaacgggtcccgagtgtcgcaacgagaccctgtatctgctgtacaaccgggaaggccagaccttggtggagagaagctccacctgggtgaaaaaggtgatctggtacctgagcggtcggaaccaaaccatcctccaacggatgccccgaacggcttcgaaaccgagcgacggaaacgtgcagatcagcgtggaagacgccaagatttttggagcgcacatggtgcccaagcgctgctacgcttcgtcgtcaacgatggcacacgttatcagatgtgtgtgatgaagctggagagctgggctcacgtcttccgggactacagcgtgtcttttcaggtgcgattgacgttcaccgaggccaataaccagacttacaccttctgcacccatcccaatctcatcgtttgataataggctggagcctcggtggccatgcttcttgccccttgggcctccccccagcccctcctccccttcctgcacccgtacccccgtggtctttgaataaagtctgagtgggcggc

SEQ ID NO: 145 - DNA, 598 bp, Artificial Sequence
  Synthetic polypeptide
tcaagcttttggaccctcgtacagaagctaatacgactcactatagggaaataagagagaaaagaagagtaagaagaaatataagagccaccatgcggctgtgtcgggtgtggctgtctgtttgtctgtgcgccgtggtgctgggtcagtgccagcgggaaaccgcggaaaagaacgattattaccgagtaccgcattactgggacgcgtgctctcgcgcgctgcccgaccaaacccgttacaagtatgtggaacagctcgtggacctcacgttgaactaccactacgatgcgagccacggcttggacaactttgacgtgctcaagagaatcaacgtgaccgaggtgtcgttgctcatcagcgactttagacgtcagaaccgtcgcggcggcaccaacaaaaggaccacgttcaacgccgccggttcgctggcgccacacgcccggagcctcgagttcagcgtgcggctctttgccaactgataataggctggagcctcggtggccatgcttcttgccccttgggcctccccccagcccctcctccccttcctgcacccgtacccccgtggtctttgaataaagtctgagtgggcggc

SEQ ID NO: 146 - DNA, 2933 bp, Artificial Sequence
  Synthetic polypeptide
tcaagcttttggaccctcgtacagaagctaatacgactcactatagggaaataagagagaaaagaagagtaagaagaaatataagagccaccatggaatccaggatctggtgcctggtagtctgcgttaacttgtgtatcgtctgtctgggtgctgcggtttcctcatcttctactcgtggaacttctgctactcacagtcaccattcctctcatacgacgtctgctgctcactctcgatccggttcagtctctcaacgcgtaacttcttcccaaacggtcagccatggtgttaacgagaccatctacaacactaccctcaagtacggagatgtggtgggggtcaataccaccaagtacccctatcgcgtgtgttctatggcccagggtacggatcttattcgctttgaacgtaatatcgtctgcacctcgatgaagcccatcaatgaagacctggacgagggcatcatggtggtctacaaacgcaacatcgtcgcgcacacctttaaggtacgagtctaccagaaggttttgacgtttcgtcgtagctacgcttacatccacaccacttatctgctgggcagcaacacggaatacgtggcgcctcctatgtgggagattcatcatatcaacagccacagtcagtgctacagttcctacagccgcgttatagcaggcacggttttcgtggcttatcatagggacagctatgaaaacaaaaccatgcaattaatgcccgacgattattccaacacccacagtacccgttacgtgacggtcaaggatcaatggcacagccgcggcagcacctggctctatcgtgagacctgtaatctgaattgtatggtgaccatcactactgcgcgctccaaatatccttatcattttttcgccacttccacgggtgacgtggttgacatttctcctttctacaacggaaccaatcgcaatgccagctactttggagaaaacgccgacaagtttttcatttttccgaactacactatcgtctccgactttggaagaccgaattctgcgttagagacccacaggttggtggcttttcttgaacgtgcggactcggtgatctcctgggatatacaggacgaaaagaatgtcacttgtcaactcactttctgggaagcctcggaacgcaccattcgttccgaagccgaggactcgtatcacttttcttctgccaaaatgaccgccactttcttatctaagaagcaagaggtgaacatgtccgactctgcgctggactgcgtacgtgatgaggctataaataagttacagcagattttcaatacttcatacaatcaaacatatgaaaaatatggaaacgtgtccgtctttgaaaccactggtggtttggtagtgttctggcaaggtatcaagcaaaaatctctggtggaactcgaacgtttggccaaccgctccagtctgaatcttactcataatagaaccaaaagaagtacagatggcaacaatgcaactcatttatccaacatggaatcggtgcacaatctggtctacgcccagctgcagttcacctatgacacgttgcgcggttacatcaaccgggcgctggcgcaaatcgcagaagcctggtgtgtggatcaacggcgcaccctagaggtcttcaaggaactcagcaagatcaacccgtcagccattctctcggccatttacaacaaaccgattgccgcgcgtttcatgggtgatgtcttgggcctggccagctgcgtgaccatcaaccaaaccagcgtcaaggtgctgcgtgatatgaacgtgaaggagtcgccaggacgctgctactcacgacccgtggtcatctttaatttcgccaacagctcgtacgtgcagtacggtcaactgggcgaggacaacgaaatcctgttgggcaaccaccgcactgaggaatgtcagcttcccagcctcaagatcttcatcgccgggaactcggcctacgagtacgtggactacctcttcaaacgcatgattgacctcagcagtatctccaccgtcgacagcatgatcgccctggatatcgacccgctggaaaataccgacttcagggtactggaactttactcgcagaaagagctgcgttccagcaacgtttttgacctcgaagagatcatgcgcgaattcaactcgtacaagcagcgggtaaagtacgtggaggacaaggtagtcgacccgctaccgccctacctcaagggtctggacgacctcatgagcggcctgggcgccgcgggaaaggccgttggcgtagccattggggccgtgggtggcgcggtggcctccgtggtcgaaggcgttgccaccttcctcaaaaaccccttcggagcgttcaccatcatcctcgtggccatagctgtagtcattatcacttatttgatctatactcgacagcggcgtttgtgcacgcagccgctgcagaacctctttccctatctggtgtccgccgacgggaccaccgtgacgtcgggcagcaccaaagacacgtcgttacaggctccgccttcctacgaggaaagtgtttataattctggtcgcaaaggaccgggaccaccgtcgtctgatgcatccacggcggctccgccttacaccaacgagcaggcttaccagatgcttctggccctggcccgtctggacgcagagcagcgagcgcagcagaacggtacagattctttggacggacggactggcacgcaggacaagggacagaagcccaacctactagaccgactgcgacatcgcaaaaacggctaccgacacttgaaagactctgacgaagaagagaacgtcttgataataggctggagcctcggtggccatgcttcttgccccttgggcctccccccagcccctcctccccttcctgcacccgtacccccgtggtctttgaataaagtctgagtgggcggc

SEQ ID NO: 147 - DNA, 1882 bp, Artificial Sequence
  Synthetic polypeptide
tcaagcttttggaccctcgtacagaagctaatacgactcactatagggaaataagagagaaaagaagagtaagaagaaatataagagccaccatggagtcgcgcggtcgccgttgtcccgaaatgatatccgtactgggtcccatttcggggcacgtgctgaaagccgtgtttagtcgcggcgatacgccggtgctgccgcacgagacgagactcctgcagacgggtatccacgtacgcgtgagccagccctcgctgatcctggtgtcgcagtacacgcccgactcgacgccatgccaccgcggcgacaatcagctgcaggtgcagcacacgtactttacgggcagcgaggtggagaacgtgtcggtcaacgtgcacaaccccacgggccgaagcatctgccccagccaagagcccatgtcgatctatgtgtacgcgctgccgctcaagatgctgaacatccccagcatcaacgtgcaccactacccgtcggcggccgagcgcaaacaccgacacctgcccgtagccgacgctgttattcacgcgtcgggcaagcagatgtggcaggcgcgtctcacggtctcgggactggcctggacgcgtcagcagaaccagtggaaagagcccgacgtctactacacgtcagcgttcgtgtttcccaccaaggacgtggcactgcggcacgtggtgtgcgcgcacgagctggtttgctccatggagaacacgcgcgcaaccaagatgcaggtgataggtgaccagtacgtcaaggtgtacctggagtccttctgcgaggacgtgccctccggcaagctctttatgcacgtcacgctgggctctgacgtggaagaggacctaacgatgacccgcaacccgcaacccttcatgcgcccccacgagcgcaacggctttacggtgttgtgtcccaaaaatatgataatcaaaccgggcaagatctcgcacatcatgctggatgtggcttttacctcacacgagcattttgggctgctgtgtcccaagagcatcccgggcctgagcatctcaggtaacctgttgatgaacgggcagcaaatcttcctggaggtacaagcgatacgcgagaccgtggaactgcgtcagtacgatcccgtggctgcgctcttctttttcgatatcgacttgttgctgcagcgcgggcctcagtacagcgagcaccccaccttcaccagccagtatcgcatccagggcaagcttgagtaccgacacacctgggaccggcacgacgagggtgccgcccagggcgacgacgacgtctggaccagcggatcggactccgacgaagaactcgtaaccaccgagcgtaagacgccccgcgtcaccggcggcggagccatggcgagcgcctccacttccgcgggctcagcatcctcggcgacggcgtgcacggcgggcgttatgacacgcggccgccttaaggccgagtccaccgtcgcgcccgaagaggacaccgacgaggattccgacaacgaaatccacaatccggccgtgttcacctggccgccctggcaggccggcatcctggcccgcaacctggtgcccatggtggctacggttcagggtcagaatctgaagtaccaggagttcttctgggacgccaacgacatctaccgcatcttcgccgaattggaaggcgtatggcagcccgctgcgcaacccaaacgtcgccgccaccggcaagacgccttgcccgggccatgcatcgcctcgacgcccaaaaagcaccgaggttgataataggctggagcctcggtggccatgcttcttgccccttgggcctccccccagcccctcctccccttcctgcacccgtacccccgtggtctttgaataaagtctgagtgggcggc

SEQ ID NO: 148 - DNA, 3364 bp, Artificial Sequence
  Synthetic polypeptide
tcaagcttttggaccctcgtacagaagctaatacgactcactatagggaaataagagagaaaagaagagtaagaagaaatataagagccaccatggagtcgcgcggtcgccgttgtcccgaaatgatatccgtactgggtcccatttcggggcacgtgctgaaagccgtgtttagtcgcggcgatacgccggtgctgccgcacgagacgcgactcctgcagacgggtatccacgtacgcgtgagccagccctcgctgatcctggtgtcgcagtacacgcccgactcgacgccatgccaccgcggcgacaatcagctgcaggtgcagcacacgtactttacgggcagcgaggtggagaacgtgtcggtcaacgtgcacaaccccacgggccgaagcatctgccccagccaagagcccatgtcgatctatgtgtacgcgctgccgctcaagatgctgaacatccccagcatcaacgtgcaccactacccgtcggcggccgagcgcaaacaccgacacctgcccgtagccgacgctgttattcacgcgtcgggcaagcagatgtggcaggcgcgtctcacggtctcgggactggcctggacgcgtcagcagaaccagtggaaagagcccgacgtctactacacgtcagcgttcgtgtttcccaccaaggacgtggcactgcggcacgtggtgtgcgcgcacgagctggtttgctccatggagaacacgcgcgcaaccaagatgcaggtgataggtgaccagtacgtcaaggtgtacctggagtccttctgcgaggacgtgccctccggcaagctctttatgcacgtcacgctgggctctgacgtggaagaggacctaacgatgacccgcaacccgcaacccttcatgcgcccccacgagcgcaacggctttacggtgttgtgtcccaaaaatatgataatcaaaccgggcaagatctcgcacatcatgctggatgtggcttttacctcacacgagcattttgggctgctgtgtcccaagagcatcccgggcctgagcatctcaggtaacctgttgatgaacgggcagcaaatcttcctggaggtacaagcgatacgcgagaccgtggaactgcgtcagtacgatcccgtggctgcgctcttctttttcgatatcgacttgttgctgcagcgcgggcctcagtacagcgagcaccccaccttcaccagccagtatcgcatccagggcaagcttgagtaccgacacacctgggaccggcacgacgagggtgccgcccagggcgacgacgacgtctggaccagcggatcggactccgacgaagaactcgtaaccaccgagcgtaagacgccccgcgtcaccggcggcggcgccatggcgagcgcctccacttccgcgggccgcaaacgcaaatcagcatcctcggcgacggcgtgcacggcgggcgttatgacacgcggccgccttaaggccgagtccaccgtcgcgcccgaagaggacaccgacgaggattccgacaacgaaatccacaatccggccgtgttcacctggccgccctggcaggccggcatcctggcccgcaacctggtgcccatggtggctacggttcagggtcagaatctgaagtaccaggagttcttctgggacgccaacgacatctaccgcatcttcgccgaattggaaggcgtatggcagcccgctgcgcaacccaaacgtcgccgccaccggcaagacgccttgcccgggccatgcatcgcctcgacgcccaaaaagcaccgaggtgagtcctctgccaagagaaagatggaccctgataatcctgacgagggcccttcctccaaggtgccacggcccgagacacccgtgaccaaggccacgacgttcctgcagactatgttaaggaaggaggttaacagtcagctgagcctgggagacccgctgttcccagaattggccgaagaatccctcaaaacctttgaacaagtgaccgaggattgcaacgagaaccccgaaaaagatgtcctgacagaactcgtcaaacagattaaggttcgagtggacatggtgcggcatagaatcaaggagcacatgctgaaaaaatatacccagacggaagaaaaattcactggcgcctttaatatgatgggaggatgtttgcagaatgccttagatatcttagataaggttcatgagcctttcgaggacatgaagtgtattgggctaactatgcagagcatgtatgagaactacattgtacctgaggataagcgggagatgtggatggcttgtattaaggagctgcatgatgtgagcaagggcgccgctaacaagttggggggtgcactgcaggctaaggcccgtgctaaaaaggatgaacttaggagaaagatgatgtatatgtgctacaggaatatagagttctttaccaagaactcagccttccctaagaccaccaatggctgcagtcaggccatggcggcattgcagaacttgcctcagtgctctcctgatgagattatgtcttatgcccagaaaatctttaagattttggatgaggagagagacaaggtgctcacgcacattgatcacatatttatggatatcctcactacatgtgtggaaacaatgtgtaatgagtacaaggtcactagtgacgcttgtatgatgaccatgtacgggggcatctctctcttaagtgagttctgtcgggtgctgtgctgctatgtcttagaggagactagtgtgatgctggccaagcggcctctgataaccaagcctgaggttatcagtgtaatgaagcgccgcattgaggagatctgcatgaaggtctttgcccagtacattctgggggccgatcctttgagagtctgctctcctagtgtggatgacctacgggccatcgccgaggagtcagatgaggaagaggctattgtagcctacactttggccaccgctggtgccagctcctctgattctctggtgtcacctccagagtcccctgtacccgcgactatccctctgtcctcagtaattgtggctgagaacagtgatcaggaagaaagtgaacagagtgatgaggaacaggaggagggtgctcaggaggagcgggaggacactgtgtctgtcaagtctgagccagtgtctgagatagaggaagttgcctcagaggaagaggaggatggtgctgaggaacccaccgcctctggaggcaagagcacccaccctatggtgactagaagcaaggctgaccagtgataataggctggagcctcggtggccatgcttcttgccccttgggcctccccccagcccctcctccccttcctgcacccgtacccccgtggtctttgaataaagtctgagtgggcggc

SEQ ID NO: 149 - DNA, 3352 bp, Artificial Sequence
  Synthetic polypeptide
tcaagcttttggaccctcgtacagaagctaatacgactcactatagggaaataagagagaaaagaagagtaagaagaaatataagagccaccatggagtcgcgcggtcgccgttgtcccgaaatgatatccgtactgggtcccatttcgggtcatgtgctgaaagcggtgtttagtcgcggcgatacgccagtactgccgcacgagacgcgactcctgcagacaggtatccacgtacgcgtgagccagccctcgctcatcctggtgtcgcagtacacgcccgactcgacgccatgccaccgcggcgacaatcagctgcaggtgcagcacacgtactttacgggcagcgaggtggagaacgtgtcggtcaacgtccacaaccccacgggtcgaagcatctgcccctctcaagagcccatgtcgatctatgtgtacgcgctgccgctcaagatgctgaacatcccgagcatcaacgtgcaccactacccgagcgcggccgagcgcaaacaccgacacctgcccgtagccgacgctgttattcacgcgtcgggcaagcagatgtggcaagcgcgcctcacggtctcgggactagcctggacgcgtcagcagaaccagtggaaagagcccgacgtctactacacgtcagcgttcgtgtttcccaccaaggacgtggcactgcgccacgtggtgtgtgcgcacgagctggtttgctccatggagaatacgcgcgcaaccaagatgcaggtgataggtgatcaatacgtcaaggtgtacctggagtccttctgcgaggatgtgccctccggtaagctctttatgcacgtcacgctgggctctgacgtggaagaggacctaacgatgacccgcaatccgcaacccttcatgcgcccccacgagcgcaacggctttacggtgttgtgtcctaaaaatatgataatcaaaccaggcaagatctcgcacatcatgctggatgtggcttttacctcacacgagcattttgggctgctgtgtcccaagagcatcccgggcctgagcatctcaggtaacctgttgatgaacgggcagcaaatctttctcgaggtgcaagctatacgcgagaccgtcgaactgcgtcagtacgatcccgtggctgcgctgttctttttcgatatcgacttgttgctgcagcgcgggcctcagtacagcgagcaccccaccttcaccagccagtatcgcatccagggcaagcttgagtaccgacacacctgggaccggcacgacgagggagccgcccagggcgacgacgacgtctggacctctggatcggactccgacgaagaactcgtaacgaccgagcgtaagaccccccgcgtcaccggcggcggcgccatggcgtccgcctcaacttccgcgggctcagcatcctcggctacggcgtgcacggcgggcgttatgacacgtggcagacttaaggccgagtccaccgtcgcgcccgaagaggacaccgacgaggattccgacaacgaaatccacaatccggccgtgttcacctggccgccctggcaggccggcatcctggcccgcaacctggtgcccatggtggctacggttcagggtcagaatctgaagtaccaggagttcttctgggacgccaacgacatctaccgcatcttcgccgaattggaaggcgtatggcagcccgctgcgcaacccaaacgtcgccgccaccggcaagacgccttgcccgggccatgcatcgcctcgacgcccaaaaagcaccgaggtgagtcctctgccaagagaaagatggaccctgataatcctgacgagggcccttcctccaaggtgccacggcccgagacacccgtgaccaaggccacgacgttcctgcagactatgttaaggaaggaggttaacagtcagctgagcctgggagacccgctgttcccagaattggccgaagaatccctcaaaacctttgaacaagtgaccgaggattgcaacgagaaccccgaaaaagatgtcctgacagaactcgtcaaacagattaaggttcgagtggacatggtgcggcatagaatcaaggagcacatgctgaaaaaatatacccagacggaagaaaaattcactggcgcctttaatatgatgggaggatgtttgcagaatgccttagatatcttagataaggttcatgagcctttcgaggacatgaagtgtattgggctaactatgcagagcatgtatgagaactacattgtacctgaggataagcgggagatgtggatggcttgtattaaggagctgcatgatgtgagcaagggcgccgctaacaagttggggggtgcactgcaggctaaggcccgtgctaaaaaggatgaacttaggagaaagatgatgtatatgtgctacaggaatatagagttctttaccaagaactcagccttccctaagaccaccaatggctgctcgcaggccatggcggcattgcagaacttgcctcagtgctctcctgatgagattatgtcttatgcccagaaaatctttaagattttggatgaggagcgagacaaggtgcttacgcacattgatcacatatttatggatatcctcactacatgtgttgaaacgatgtgcaatgagtacaaggtcactagtgacgcttgtatgatgaccatgtacgggggcatatctctcttaagtgaattctgtcgggtgctgtgctgctacgtcttagaggagactagtgtgatgctggccaagcggcctctgataaccaagcctgaggtcatcagtgtaatgaagcgccgcattgaggagatctgcatgaaggtctttgcccagtacattctgggggccgatcctttgagagtctgctctccaagtgtggatgacctacgggccatcgccgaggagtcagacgaggaagaggctattgtagcctacactttggccaccgctggtgccagctcctctgactctctggtgtcacctccagaatcccctgtgcccgcgacaatccctctgtcctcagtaattgtggctgagaacagtgatcaggaagaaagtgaacagagtgatgaggaacaggaggagggtgctcaggaggagcgggaggatactgtgtctgtcaagtctgagccagtgtctgaaattgaggaagttgcctcagaggaagaggaggatggtgctgaggaacccaccgcctctggaggcaagtccacccaccctatggtaactagatcaaaggctgaccagtgataataggctggagcctcggtggccatgcttcttgccccttgggcctccccccagcccctcctccccttcctgcacccgtacccccgtggtctttgaataaagtctgagtgggcggc

SEQ ID NO: 150 - DNA, 1473 bp, Artificial Sequence
  Synthetic polypeptide
atggagtcctctgccaagagaaagatggaccctgataatcctgacgagggcccttcctccaaggtgccacggcccgagacacccgtgaccaaggccacgacgttcctgcagactatgttaaggaaggaggttaacagtcagctgagcctgggagacccgctgttcccagaattggccgaagaatccctcaagacctttgaacaagtgaccgaggattgcaacgagaaccccgagaaagatgtcctgacagaactcgtcaaacagattaaggttcgagtggacatggtgcggcatagaatcaaggagcacatgctgaagaaatatacccagacggaagagaaattcactggcgcctttaatatgatgggaggatgtttgcagaatgccttagatatcttagataaggttcatgagcctttcgaggacatgaagtgtattgggctaactatgcagagcatgtatgagaactacattgtacctgaggataagcgggagatgtggatggcttgtattaaggagctgcatgatgtgagcaagggcgccgctaacaagttgggcggtgcactgcaggctaaggcccgtgctaagaaggatgaacttaggagaaagatgatgtatatgtgctacaggaatatagagttctttaccaagaactcagccttccctaagaccaccaatggctgcagtcaggccatggcggcattgcagaacttgcctcagtgctctcctgatgagattatgtcttatgcccagaagatctttaagattttggatgaggagagagacaaggtgctcacgcacattgatcacatatttatggatatcctcactacatgtgtggaaacaatgtgtaatgagtacaaggtcactagtgacgcttgtatgatgaccatgtacggcggcatctctctcttaagtgagttctgtcgggtgctgtgctgctatgtcttagaggagactagtgtgatgctggccaagcggcctctgataaccaagcctgaggttatcagtgtaatgaagcgccgcattgaggagatctgcatgaaggtctttgcccagtacattctgggagccgatcctttgagagtctgctctcctagtgtggatgacctacgggccatcgccgaggagtcagatgaggaagaggctattgtagcctacactttggccaccgctggtgccagctcctctgattctctggtgtcacctccagagtcccctgtacccgcgactatccctctgtcctcagtaattgtggctgagaacagtgatcaggaagaaagtgaacagagtgatgaggaacaggaggagggtgctcaggaggagcgggaggacactgtgtctgtcaagtctgagccagtgtctgagatagaggaagttgcctcagaggaagaggaggatggtgctgaggaacccaccgcctctggaggcaagagcacccaccctatggtgactagaagcaaggctgaccag

SEQ ID NO: 151 - DNA, 1740 bp, Artificial Sequence
  Synthetic polypeptide
atggagtcctctgccaagagaaagatggaccctgataatcctgacgagggcccttcctccaaggtgccacggcccgagacacccgtgaccaaggccacgacgttcctgcagactatgttaaggaaggaggttaacagtcagctgagcctgggagacccgctgttcccagaattggccgaagaatccctcaagacctttgaacaagtgaccgaggattgcaacgagaaccccgagaaagatgtcctgacagaactcggtgacatcctcgcccaggctgtcaatcatgccggtatcgattccagtagcaccggccccacgctgacaacccactcttgcagcgttagcagcgcccctcttaacaagccgacgcccaccagcgtcgcggttactaacactcctctccccggggcatccgctactcccgagctcagcccgcgtaagaaaccgcgcaagaccacgcgtcctttcaaggtgattattaaaccgcccgtgcctcccgcgcctatcatgctgcccctcatcaaacaggaagacatcaagcccgagcccgactttaccatccagtaccgcaacaagattatcgataccgccggctgtatcgtgatctctgatagcgaggaagaacagggtgaagaagtcgagacccgcggtgctaccgcgtcttccccttccaccggcagcggcacgccgcgagtgacctctcccacgcacccgctctcccagatgaaccaccctcctcttcccgatcctttgggccggcccgatgaagatagttcctcttcgtcttcctcctcctgcagttcggcttcggacagcgagagtgagtccgaggagatgaaatgcagcagtggcggaggagcatccgtgacctcgagccaccatgggcgcggcggttttggtggcgcggcctcctcctctctgctgagctgcggacatcagagcagcggcggggcgagcaccggacctcgcaagaagaagagcaaacgcatctccgagttggacaacgagaaggtgcgcaatatcatgaaagataagaacacgcccttctgcacacccaacgtgcagactcggcggggtcgcgtcaagattgacgaggtgagccgcatgttccgtcacaccaatcgttctcttgagtacaagaatctgccattcatgatccctagtatgcaccaagtgttagaagaggccatcaaagtttgcaagaccatgcaggtgaacaacaagggcattcagatcatctacacccgcaatcatgaagtgaagaatgaggtggatcaggtacggtgtcgcctgggtagcatgtgcaacctggccctctccactcccttcctcatggagcacactatgcctgtgacacaccctcctgatgtggcgcagcgcacggccgatgcttgtaacgacggtgtcaaggccgtgtggaacctcaaagaactgcacacccaccaattgtgcccgcgctcttctgattaccgcaacatgattatccacgctgccacgcccgtggacctgttgggcgctctcaacctgtgcctgcccctgatgcagaagtttcccaaacaggtcatggtgcgcatcttctccaccaaccagggtgggttcatgctgcctatctacgagacggccgcgaaggcctacgccgtggggcagtttgagaagcccaccgagacccctcccgaagacctggacaccctgagcctggccatcgaggcagccatccaggacctgaggaacaaatctcag

SEQ ID NO: 152 - DNA, 2721 bp, Artificial Sequence
  Synthetic polypeptide
atggaatccaggatctggtgcctggtagtctgcgttaacttgtgtatcgtctgtctgggtgctgcggtttcctcatcttctactcgtggaacttctgctactcacagtcaccattcctctcatacgacgtctgctgctcactctcgatccggttcagtctctcaacgcgtaacttcttcccaaacggtcagccatggtgttaacgagaccatctacaacactaccctcaagtacggagatgtggtgggggtcaataccaccaagtacccctatcgcgtgtgttctatggcccagggtacggatcttattcgctttgaacgtaatatcgtctgcacctcgatgaagcccatcaatgaagacctggacgagggcatcatggtggtctacaaacgcaacatcgtcgcgcacacctttaaggtacgagtctaccagaaggttttgacgtttcgtcgtagctacgcttacatccacaccacttatctgctgggcagcaacacggaatacgtggcgcctcctatgtgggagattcatcatatcaacagccacagtcagtgctacagttcctacagccgcgttatagcaggcacggttttcgtggcttatcatagggacagctatgaaaacaaaaccatgcaattaatgcccgacgattattccaacacccacagtacccgttacgtgacggtcaaggatcaatggcacagccgcggcagcacctggctctatcgtgagacctgtaatctgaattgtatggtgaccatcactactgcgcgctccaaatatccttatcattttttcgccacttccacgggtgacgtggttgacatttctcctttctacaacggaaccaatcgcaatgccagctactttggagaaaacgccgacaagtttttcatttttccgaactacactatcgtctccgactttggaagaccgaattctgcgttagagacccacaggttggtggcttttcttgaacgtgcggactcggtgatctcctgggatatacaggacgaaaagaatgtcacttgtcaactcactttctgggaagcctcggaacgcaccattcgttccgaagccgaggactcgtatcacttttcttctgccaaaatgaccgccactttcttatctaagaagcaagaggtgaacatgtccgactctgcgctggactgcgtacgtgatgaggctataaataagttacagcagattttcaatacttcatacaatcaaacatatgaaaaatatggaaacgtgtccgtctttgaaaccactggtggtttggtagtgttctggcaaggtatcaagcaaaaatctctggtggaactcgaacgtttggccaaccgctccagtctgaatcttactcataatagaaccaaaagaagtacagatggcaacaatgcaactcatttatccaacatggaatcggtgcacaatctggtctacgcccagctgcagttcacctatgacacgttgcgcggttacatcaaccgggcgctggcgcaaatcgcagaagcctggtgtgtggatcaacggcgcaccctagaggtcttcaaggaactcagcaagatcaacccgtcagccattctctcggccatttacaacaaaccgattgccgcgcgtttcatgggtgatgtcttgggcctggccagctgcgtgaccatcaaccaaaccagcgtcaaggtgctgcgtgatatgaacgtgaaggagtcgccaggacgctgctactcacgacccgtggtcatctttaatttcgccaacagctcgtacgtgcagtacggtcaactgggcgaggacaacgaaatcctgttgggcaaccaccgcactgaggaatgtcagcttcccagcctcaagatcttcatcgccgggaactcggcctacgagtacgtggactacctcttcaaacgcatgattgacctcagcagtatctccaccgtcgacagcatgatcgccctggatatcgacccgctggaaaataccgacttcagggtactggaactttactcgcagaaagagctgcgttccagcaacgtttttgacctcgaagagatcatgcgcgaattcaactcgtacaagcagcgggtaaagtacgtggaggacaaggtagtcgacccgctaccgccctacctcaagggtctggacgacctcatgagcggcctgggcgccgcgggaaaggccgttggcgtagccattggggccgtgggtggcgcggtggcctccgtggtcgaaggcgttgccaccttcctcaaaaaccccttcggagcgttcaccatcatcctcgtggccatagctgtagtcattatcacttatttgatctatactcgacagcggcgtttgtgcacgcagccgctgcagaacctctttccctatctggtgtccgccgacgggaccaccgtgacgtcgggcagcaccaaagacacgtcgttacaggctccgccttcctacgaggaaagtgtttataattctggtcgcaaaggaccgggaccaccgtcgtctgatgcatccacggcggctccgccttacaccaacgagcaggcttaccagatgcttctggccctggcccgtctggacgcagagcagcgagcgcagcagaacggtacagattctttggacggacggactggcacgcaggacaagggacagaagcccaacctactagaccgactgcgacatcgcaaaaacggctaccgacacttgaaagactctgacgaagaagagaacgtc

SEQ ID NO: 153 - DNA, 2226 bp, Artificial Sequence
  Synthetic polypeptide
atgcggccaggcctcccctcctacctcatcatcctcgccgtctgtctcttcagccacctactttcgtcacgatatggcgcagaagccgtatccgaaccgctggacaaagcgtttcacctactgctcaacacctacgggagacccatccgcttcctgcgtgaaaataccacccagtgtacctacaacagcagcctccgtaacagcacggtcgtcagggaaaacgccatcagtttcaacttcttccaaagctataatcaatactatgtattccatatgcctcgatgtctctttgcgggtcctctggcggagcagtttctgaaccaggtagatctgaccgaaaccctggaaagataccaacagagacttaacacttacgcgctggtatccaaagacctggccagctaccgatctttctcgcagcagctaaaggcacaagacagcctaggtgaacagcccaccactgtgccaccgcccattgacctgtcaatacctcacgtttggatgccaccgcaaaccactccacacggctggacagaatcacataccacctcaggactacaccgaccacactttaaccagacctgtatcctctttgatggacacgatctactattcagcaccgtcacaccttgtttgcaccaaggcttttacctcatcgacgaactacgttacgttaaaataacactgaccgaggacttcttcgtagttacggtgtccatagacgacgacacacccatgctgcttatcttcggccatcttccacgcgtacttttcaaagcgccctatcaacgcgacaactttatactacgacaaactgagaaacacgagctcctggtgctagttaagaaagatcaactgaaccgtcactcttatctcaaagacccggactttcttgacgccgcacttgacttcaactacctagacctcagcgcactactacgtaacagctttcaccgttacgccgtggatgtactcaagagcggtcgatgtcagatgctggaccgccgcacggtagaaatggccttcgcctacgcattagcactgttcgcagcagcccgacaagaagaggccggcgcccaagtctccgtcccacgggccctagaccgccaggccgcactcttacaaatacaagaatttatgatcacctgcctctcacaaacaccaccacgcaccacgttgctgctgtatcccacggccgtggacctggccaaacgagccctttggacaccgaatcagatcaccgacatcaccagcctcgtacgcctggtctacatactctctaaacagaatcagcaacatctcatcccccaatgggcactacgacagatcgccgactttgccctaaaactacacaaaacgcacctggcctcttttctttcagccttcgcacgccaagaactctacctcatgggcagcctcgtccactccatgctggtacatacgacggagagacgcgaaatcttcatcgtagaaacgggcctctgttcattggccgagctatcacactttacgcagttgttagctcatccacaccacgaatacctcagcgacctgtacacaccctgttccagtagcgggcgacgcgatcactcgctcgaacgcctcacgcgtctcttccccgatgccaccgtccccgctaccgttcccgccgccctctccatcctatctaccatgcaaccaagcacgctggaaaccttccccgacctgttttgcttgccgctcggcgaatccttctccgcgctgaccgtctccgaacacgtcagttatatcgtaacaaaccagtacctgatcaaaggtatctcctaccctgtctccaccaccgtcgtaggccagagcctcatcatcacccagacggacagtcaaactaaatgcgaactgacgcgcaacatgcataccacacacagcatcacagtggcgctcaacatttcgctagaaaactgcgccttttgccaaagcgccctgctagaatacgacgacacgcaaggcgtcatcaacatcatgtacatgcacgactcggacgacgtccttttcgccctggatccctacaacgaagtggtggtctcatctccgcgaactcactacctcatgcttttgaagaacggtacggtactagaagtaactgacgtcgtcgtggacgccaccgacagtcgtctcctcatgatgtccgtctacgcgctatcggccatcatcggcatctatctgctctaccgcatgctcaagacatgc

SEQ ID NO: 154 - DNA, 2226 bp, Artificial Sequence; identical to SEQ ID NO: 153
  Synthetic polypeptide

SEQ ID NO: 155 - DNA, 513 bp, Artificial Sequence
  Synthetic polypeptide
atgagtcccaaagatctgacgccgttcttgacggcgttgtggctgctattgggtcacagccgcgtgccgcgggtgcgcgcagaagaatgttgcgaattcataaacgtcaaccacccgccggaacgctgttacgatttcaaaatgtgcaatcgcttcaccgtcgcgctgcggtgtccggacggcgaagtctgctacagtcccgagaaaacggctgagattcgcgggatcgtcaccaccatgacccattcattgacacgccaggtcgtacacaacaaactgacgagctgcaactacaatccgttatacctcgaagctgacgggcgaatacgctgcggcaaagtaaacgacaaggcgcagtacctgctgggcgccgctggcagcgttccctatcgatggatcaatctggaatacgacaagataacccggatcgtgggcctggatcagtacctggagagcgttaagaaacacaaacggctggatgtgtgccgcgctaaaatgggctatatgctgcag

SEQ ID NO: 156 - DNA, 834 bp, Artificial Sequence
  Synthetic polypeptide
atgtgccgccgcccggattgcggcttctctttctcacctggaccggtgatactgctgtggtgttgccttctgctgcccattgtttcctcagccgccgtcagcgtcgctcctaccgccgccgagaaagtccccgcggagtgccccgaactaacgcgccgatgcttgttgggtgaggtgtttgagggtgacaagtatgaaagttggctgcgcccgttggtgaatgttaccgggcgcgatggcccgctatcgcaacttatccgttaccgtcccgttacgccggaggccgccaactccgtgctgttggacgaggctttcctggacactctggccctgctgtacaacaatccggatcaattgcgggccctgctgacgctgttgagctcggacacagcgccgcgctggatgacggtgatgcgcggctacagcgagtgcggcgatggctcgccggccgtgtacacgtgcgtggacgacctgtgccgcggctacgacctcacgcgactgtcatacgggcgcagcatcttcacggaacacgtgttaggcttcgagctggtgccaccgtctctctttaacgtggtggtggccatacgcaacgaagccacgcgtaccaaccgcgccgtgcgtctgcccgtgagcaccgctgccgcgcccgagggcatcacgctcttttacggcctgtacaacgcagtgaaggaattctgcctgcgtcaccagctggacccgccgctgctacgccacctagataaatactacgccggactgccgcccgagctgaagcagacgcgcgtcaacctgccggctcactcgcgctatggccctcaagcagtggatgctcgc

SEQ ID NO: 157 - DNA, 642 bp, Artificial Sequence
  Synthetic polypeptide
atgctgcggcttctgcttcgtcaccactttcactgcctgcttctgtgcgcggtttgggcaacgccctgtctggcgtctccgtggtcgacgctaacagcaaaccagaatccgtccccgccatggtctaaactgacgtattccaaaccgcatgacgcggcgacgttttactgtccttttctctatccctcgcccccacgatcccccttgcaattctcggggttccagcgggtatcaacgggtcccgagtgtcgcaacgagaccctgtatctgctgtacaaccgggaaggccagaccttggtggagagaagctccacctgggtgaaaaaggtgatctggtacctgagcggtcggaaccaaaccatcctccaacggatgccccgaacggcttcgaaaccgagcgacggaaacgtgcagatcagcgtggaagacgccaagatttttggagcgcacatggtgcccaagcagaccaagctgctacgcttcgtcgtcaacgatggcacacgttatcagatgtgtgtgatgaagctggagagctgggctcacgtcttccgggactacagcgtgtcttttcaggtgcgattgacgttcaccgaggccaataaccagacttacaccttctgcacccatcccaatctcatcgtt

SEQ ID NO: 158 - DNA, 1671 bp, Artificial Sequence
  Synthetic polypeptide
atggagtcgcgcggtcgccgttgtcccgaaatgatatccgtactgggtcccatttcggggcacgtgctgaaagccgtgtttagtcgcggcgatacgccggtgctgccgcacgagacgagactcctgcagacgggtatccacgtacgcgtgagccagccctcgctgatcctggtgtcgcagtacacgcccgactcgacgccatgccaccgcggcgacaatcagctgcaggtgcagcacacgtactttacgggcagcgaggtggagaacgtgtcggtcaacgtgcacaaccccacgggccgaagcatctgccccagccaagagcccatgtcgatctatgtgtacgcgctgccgctcaagatgctgaacatccccagcatcaacgtgcaccactacccgtcggcggccgagcgcaaacaccgacacctgcccgtagccgacgctgttattcacgcgtcgggcaagcagatgtggcaggcgcgtctcacggtctcgggactggcctggacgcgtcagcagaaccagtggaaagagcccgacgtctactacacgtcagcgttcgtgtttcccaccaaggacgtggcactgcggcacgtggtgtgcgcgcacgagctggtttgctccatggagaacacgcgcgcaaccaagatgcaggtgataggtgaccagtacgtcaaggtgtacctggagtccttctgcgaggacgtgccctccggcaagctctttatgcacgtcacgctgggctctgacgtggaagaggacctaacgatgacccgcaacccgcaacccttcatgcgcccccacgagcgcaacggctttacggtgttgtgtcccaaaaatatgataatcaaaccgggcaagatctcgcacatcatgctggatgtggcttttacctcacacgagcattttgggctgctgtgtcccaagagcatcccgggcctgagcatctcaggtaacctgttgatgaacgggcagcaaatcttcctggaggtacaagcgatacgcgagaccgtggaactgcgtcagtacgatcccgtggctgcgctcttctttttcgatatcgacttgttgctgcagcgcgggcctcagtacagcgagcaccccaccttcaccagccagtatcgcatccagggcaagcttgagtaccgacacacctgggaccggcacgacgagggtgccgcccagggcgacgacgacgtctggaccagcggatcggactccgacgaagaactcgtaaccaccgagcgtaagacgccccgcgtcaccggcggcggagccatggcgagcgcctccacttccgcgggctcagcatcctcggcgacggcgtgcacggcgggcgttatgacacgcggccgccttaaggccgagtccaccgtcgcgcccgaagaggacaccgacgaggattccgacaacgaaatccacaatccggccgtgttcacctggccgccctggcaggccggcatcctggcccgcaacctggtgcccatggtggctacggttcagggtcagaatctgaagtaccaggagttcttctgggacgccaacgacatctaccgcatcttcgccgaattggaaggcgtatggcagcccgctgcgcaacccaaacgtcgccgccaccggcaagacgccttgcccgggccatgcatcgcctcgacgcccaaaaagcaccgaggt

SEQ ID NO: 159 - DNA, 1683 bp, Artificial Sequence
  Synthetic polypeptide
atggagtcgcgcggtcgccgttgtcccgaaatgatatccgtactgggtcccatttcggggcacgtgctgaaagccgtgtttagtcgcggcgatacgccggtgctgccgcacgagacgcgactcctgcagacgggtatccacgtacgcgtgagccagccctcgctgatcctggtgtcgcagtacacgcccgactcgacgccatgccaccgcggcgacaatcagctgcaggtgcagcacacgtactttacgggcagcgaggtggagaacgtgtcggtcaacgtgcacaaccccacgggccgaagcatctgccccagccaagagcccatgtcgatctatgtgtacgcgctgccgctcaagatgctgaacatccccagcatcaacgtgcaccactacccgtcggcggccgagcgcaaacaccgacacctgcccgtagccgacgctgttattcacgcgtcgggcaagcagatgtggcaggcgcgtctcacggtctcgggactggcctggacgcgtcagcagaaccagtggaaagagcccgacgtctactacacgtcagcgttcgtgtttcccaccaaggacgtggcactgcggcacgtggtgtgcgcgcacgagctggtttgctccatggagaacacgcgcgcaaccaagatgcaggtgataggtgaccagtacgtcaaggtgtacctggagtccttctgcgaggacgtgccctccggcaagctctttatgcacgtcacgctgggctctgacgtggaagaggacctaacgatgacccgcaacccgcaacccttcatgcgcccccacgagcgcaacggctttacggtgttgtgtcccaagaatatgataatcaaaccgggcaagatctcgcacatcatgctggatgtggcttttacctcacacgagcattttgggctgctgtgtcccaagagcatcccgggcctgagcatctcaggtaacctgttgatgaacgggcagcaaatcttcctggaggtacaagcgatacgcgagaccgtggaactgcgtcagtacgatcccgtggctgcgctcttctttttcgatatcgacttgttgctgcagcgcgggcctcagtacagcgagcaccccaccttcaccagccagtatcgcatccagggcaagcttgagtaccgacacacctgggaccggcacgacgagggtgccgcccagggcgacgacgacgtctggaccagcggatcggactccgacgaagaactcgtaaccaccgagcgtaagacgccccgcgtcaccggcggcggcgccatggcgagcgcctccacttccgcgggccgcaaacgcaaatcagcatcctcggcgacggcgtgcacggcgggcgttatgacacgcggccgccttaaggccgagtccaccgtcgcgcccgaagaggacaccgacgaggattccgacaacgaaatccacaatccggccgtgttcacctggccgccctggcaggccggcatcctggcccgcaacctggtgcccatggtggctacggttcagggtcagaatctgaagtaccaggagttcttctgggacgccaacgacatctaccgcatcttcgccgaattggaaggcgtatggcagcccgctgcgcaacccaaacgtcgccgccaccggcaagacgccttgcccgggccatgcatcgcctcgacgcccaagaagcaccgaggt

SEQ ID NO: 160 - DNA, 2721 bp, Artificial Sequence
  Synthetic polypeptide
atggaaagccggatctggtgtcttgtggtgtgcgtgaatctttgcatcgtgtgcttgggtgccgccgtgtcatctagcagcacaagaggcacctccgccactcactcacaccacagcagccacacgaccagcgccgctcactccagaagcggctctgtaagccagagagtgaccagttctcaaaccgtcagccacggcgtcaatgagacgatatataatacaaccctgaagtatggagacgtggtgggtgtcaataccaccaagtacccttatcgcgtgtgcagcatggcccagggcactgacctgatcagattcgagagaaatatcgtctgcacctccatgaagcctatcaacgaggaccttgacgagggcatcatggttgtctacaagagaaacattgtggctcacaccttcaaggtgagagtgtatcagaaagtactgacctttaggagatcctacgcttacatccacaccacgtacctgctcggctccaacaccgagtatgtggctccacccatgtgggagattcatcacatcaattcccacagccaatgttacagttcctatagcagagtcattgctggtaccgtgttcgtcgcttaccacagagacagctatgagaacaagaccatgcagttgatgcccgatgactactccaatacacactctacaaggtatgtgacagtcaaagatcagtggcacagccggggcagcacctggctgtaccgagagacatgtaatctgaattgtatggtgactatcactacagccaggagcaaatatccataccacttcttcgccactagcaccggggacgtcgtggacatttccccattctacaatggcacaaacagaaacgccagctacttcggcgagaatgccgacaagttctttatattccccaactataccatcgtgagcgacttcggccgccccaacagcgccctggaaacccaccggctcgtggcctttctcgagcgggccgatagcgtcatatcctgggacatccaggacgagaagaatgtgacatgccagctgaccttctgggaggcctccgagcgtaccatccggtccgaggcagaggacagctaccatttcagcagcgccaagatgaccgcaaccttcctcagtaagaaacaggaggttaacatgtctgattctgccctggactgcgtgcgcgatgaggcaatcaacaagctgcagcagatcttcaacacatcttacaaccaaacttacgagaagtacggcaacgtcagcgtgttcgagacaacaggaggcctggtagtgttctggcaaggtatcaagcagaagagtctggtggagctcgagcgactggctaaccgcagctccctcaacctgacccataataggacaaagagaagcaccgacggcaacaacgctactcatttgagcaacatggaatccgtgcacaacctggtgtatgcccagctgcagttcacttacgacaccctgagaggctacatcaatagagccttagctcagatcgcagaggcttggtgtgtggaccagcgaagaactctggaggtgttcaaggagttaagtaagatcaatccatccgccatcctgtctgctatctacaacaagcccattgccgccaggttcatgggagatgtgctcggcctggctagttgtgtcaccatcaaccagacctccgtgaaggtgctgcgggacatgaatgtgaaggagagccccggtcggtgttactccagaccagtggtgattttcaacttcgccaacagctcctatgtgcagtacggacagctcggagaggataacgagatcttgctcggcaatcacagaactgaggagtgtcagctgccatcactgaagatatttattgccgggaattccgcctacgaatacgttgactaccttttcaagagaatgatcgacctgagcagcatcagcaccgtcgacagcatgattgctctcgatatcgaccctctggagaacaccgactttagagtccttgagctgtattcacagaaggagctgaggagctccaatgtgttcgacctggaggaaatcatgagagagttcaactcttacaagcagcgggtgaagtacgtggaggataaggtagtggacccactcccaccatacctgaaaggactcgacgatctcatgagcggactgggcgcagccgggaaggctgttggcgtcgccatcggagcggtcggaggagcagtggctagcgtggtggagggcgtggccaccttcctgaagaaccctttcggcgcctttaccatcatcctggtggccatcgccgtggtcatcattacatatctgatttatacaagacagagaaggctctgcacccagcccttgcagaacctgttcccctacctggtcagtgccgacggtacaaccgtgaccagcggtagcaccaaggacacctccctgcaggcaccgccgagctacgaggagtccgtgtataacagtggaagaaagggccccggaccgcccagcagcgacgcatccaccgccgctcctccctacacaaatgagcaggcctatcagatgttgctggctctggcacgcctggacgccgagcagcgagctcagcagaacggcaccgattccctggatggacgcacaggcacacaggacaaggggcagaagcccaacctcctcgacagactgagacaccggaagaacggatacaggcatctgaaggactccgatgaggaggagaacgtt

SEQ ID NO: 161 - DNA, 2721 bp, Artificial Sequence
  Synthetic polypeptide
atggaatccaggatctggtgcctcgtggtctgtgtgaacttgtgcatcgtgtgcttgggtgccgccgtgagcagtagcagcaccagaggcaccagcgcaacacactcacaccacagctcccataccacttccgccgcccactccagatcgggctccgtgagccagagggtcaccagcagccagacggtgtcccacggagtgaatgaaaccatctacaacactactctgaagtacggagacgtcgtcggcgtgaataccactaagtacccctacagggtctgctctatggcccaaggcacagacctgatcagatttgaaagaaatatcgtctgtacctccatgaagcccatcaatgaggacttagacgagggcattatggtggtgtataaacgcaacattgtggcccacactttcaaggtcagagtgtatcagaaagtgctcaccttcaggcgtagctatgcctatatccacaccacttatctcctcggcagcaacaccgagtatgttgccccgcctatgtgggagattcaccatataaatagccatagccagtgctacagctcctattcgagagtaatcgccggaaccgttttcgtcgcctaccacagagactcgtacgagaacaagacaatgcagctgatgccagatgactattcgaacacccacagcacgagatatgtcaccgtgaaagatcagtggcacagcaggggtagtacatggttgtatagggaaacctgcaatctcaattgcatggtgaccatcaccaccgccagaagcaaatacccctatcatttcttcgctacctcgacaggagacgtggtggacatatctcccttttataatggcacaaatagaaatgctagctactttggagagaacgccgacaaattcttcatcttccctaactataccatcgtgagcgactttgggcgacctaacagcgccctcgagactcacaggctggtggctttcttagagagggctgatagtgttatctcttgggacattcaggatgagaagaacgtgacatgccagctgacattttgggaggctagcgagcgaaccatcaggtccgaggccgaggacagctaccatttctctagtgccaagatgaccgccaccttcttgtcaaagaagcaagaggtgaacatgtccgactctgcgctggactgtgtccgcgacgaggcaattaataaactgcagcagatctttaataccagctacaaccagacatacgagaagtatggcaacgtgagcgtcttcgaaaccacaggcggccttgtcgtcttttggcaaggcatcaagcagaagagtctggtggagctggaaagactcgccaaccggtcatccctgaatctgacccacaataggacaaagcgcagcaccgatgggaacaacgccacccacctgtcgaacatggagtcagtgcacaacctggtgtacgcccagctgcagttcacttatgataccctcagaggctacattaaccgcgcactggctcagatcgccgaagcatggtgcgtggaccagcggcgaaccctggaagtgtttaaagagctctccaagattaatcctagcgccatcctgagtgctatctacaataagcctatcgccgcaagatttatgggcgacgtgctgggactggcttcctgcgtgacaattaaccagacctccgtcaaggtgctgagggacatgaacgtgaaggagagccccggcagatgctatagccggccagtggtgatcttcaatttcgccaacagctcatacgtgcagtacggccagctcggggaggataatgaaatcctgctgggaaatcacagaaccgaggagtgtcagctgcccagtctgaagattttcatcgcaggcaacagtgcctatgaatacgtggactatctgttcaaacgcatgatcgatctgagctctatctccaccgtggactccatgattgccttggatatcgacccactggagaacaccgatttcagagtgctggagctgtacagccagaaggagctcaggtccagcaatgtgttcgacctggaggaaatcatgagagagttcaactcctacaaacagagagtcaagtacgtggaggacaaggtggtggatcccctgcctccctacctgaaggggctggacgacctgatgagtggcctgggagccgccggcaaagctgtgggagtggccatcggtgccgtcggaggggctgtggccagcgtcgtcgagggagttgccacattcctgaagaaccccttcggggccttcaccattatcctagtcgccattgccgtggtcatcattacctatctgatctacacgcggcagagacggctgtgcacccagcctttgcagaacctgttcccctatttagtgtccgctgacgggaccactgtgacaagcggaagcaccaaggacacatccctgcaggccccacccagctacgaggagtctgtttacaattctggccggaagggccccggccctccctcttctgacgcctccaccgcagcccctccttacacaaacgagcaggcttaccagatgctgttggctttggcccgtctggacgccgaacagagggcccagcagaatggcaccgactccttggacggccggacagggacccaggataagggtcagaagcctaacctactggatcggctccgccatcgcaagaatggctacagacatctcaaggacagcgacgaagaagagaatgtg

SEQ ID NO: 162 - DNA, 2721 bp, Artificial Sequence
  Synthetic polypeptide
atggaatcaagaatctggtgtctcgtggtgtgcgtgaacctgtgtatcgtctgtcttggcgccgccgtctcttcctcaagcacccggggtaccagtgccacccactcacatcactcctcccacactaccagcgccgcccacagcagatccggctccgtgtcccagcgggtgaccagcagccagaccgtgtcacacggcgttaatgaaaccatttacaacaccacactgaagtacggggacgtggtgggcgtgaacaccaccaagtatccctacagggtgtgcagcatggcccagggcaccgacctgattcggttcgagagaaacatcgtgtgcacatccatgaagcctatcaatgaggacctcgacgagggcatcatggtggtttacaagaggaacattgtcgcacacacatttaaggtgcgagtgtaccagaaggtgttaaccttcagaaggtcctacgcatacatccacaccacctacctcctgggctctaacacagaatacgtcgcccctcccatgtgggagattcaccacatcaacagtcacagccagtgctacagctcgtatagcagagttatcgctggcaccgtgttcgtggcttatcaccgcgacagctacgagaacaagacgatgcaacttatgcccgacgattactcaaacacgcactccactagatacgtgactgtgaaggaccagtggcacagtagaggcagcacctggctgtaccgggaaacatgcaatctcaattgtatggtcaccattaccaccgccaggtccaagtacccttaccacttcttcgccacctccactggcgacgtggtcgacatcagccccttctacaatggcaccaacaggaacgcctcttactttggggagaacgccgataaattctttattttccccaactacactattgtctccgactttggcagacccaactcagcattggaaacccacaggctcgtggccttcctggagcgggccgatagtgtgatcagctgggacatccaggatgagaagaacgtgacatgccagctgaccttctgggaggccagcgaacgaaccatccggtccgaggccgaggactcttatcacttctctagcgcaaagatgaccgccaccttcctgtctaagaaacaggaggtgaacatgagcgacagcgccctggactgcgtcagagacgaggcaatcaacaagctgcagcaaatcttcaacaccagctacaaccaaacctacgagaaatacggcaacgtcagcgtcttcgagactaccggagggctcgttgttttctggcagggcattaagcagaagtctctggtcgagctggaaaggctggccaatagaagctccctaaacctcactcacaacagaactaagagaagcaccgatggcaataacgccactcatctgagtaacatggagtctgttcacaacctggtgtatgcccagctgcagtttacttatgacacactgaggggctacatcaatcgagccctggcccagatcgccgaggcttggtgcgtcgaccagagaagaacactggaagtgttcaaggagctgagtaagattaatcccagcgccattctgtccgccatctacaataagccaatcgccgcaagattcatgggtgacgtgctgggcctggcctcctgcgtgacaatcaaccagacaagcgtgaaagtcctcagagacatgaacgtcaaggagtctcctggcaggtgttactcccggcccgtggtgatatttaatttcgccaacagcagttacgtgcagtacggacagctgggcgaggataacgagatactgctcggaaaccatagaacagaggagtgccaactgccctccctgaagattttcatcgccgggaacagcgcctatgagtatgttgactatctgttcaagcggatgatcgacctgagttctatcagcaccgttgactccatgattgctctcgatatcgatcctctggagaacaccgatttcagagtgctggaactctactctcagaaagagctaagaagctcgaacgtgttcgacctggaagaaatcatgagagagttcaactcctacaaacagagggttaagtacgtagaggataaggtcgtggaccctctgcctccataccttaagggattagatgatctgatgagcggcctgggcgctgccggaaaggccgtgggagtggccatcggcgcagtgggtggtgccgtggctagcgtcgtggaaggcgttgccacattcttgaagaacccattcggggccttcacaatcatcctggtggctatcgccgttgtgattatcacatatctgatctacactcgccagcggaggctctgcacccagcctctgcagaaccttttcccctacctagtgtccgctgatgggactacagtcactagcggcagcactaaggacacatccctgcaggctcctccatcttacgaggagagcgtgtataactccgggcgcaagggacctggccctcccagcagcgacgccagcacggcggctcctccctacaccaacgagcaggcataccagatgttgcttgcactggcccgtctggacgctgagcagagggcccagcagaatgggactgattccctggacggcagaaccggcacacaggataaaggacagaaaccgaatctgctcgacaggctgaggcaccggaagaatggatacaggcatctgaaggacagtgacgaggaggagaacgtg

SEQ ID NO: 163 - DNA, 2721 bp, Artificial Sequence
  Synthetic polypeptide
atggagtcaagaatctggtgcttggtggtgtgtgtgaacttgtgtatcgtgtgccttggagccgccgtgagcagcagctccaccagaggcaccagcgccacccacagccatcactcttcccacaccacaagcgccgcccactcgcggagcgggagtgtttcccaacgggtgacaagcagccagactgtgagccacggcgttaacgagacaatctacaacacaacactgaagtacggcgacgtggtgggtgtaaatactaccaagtatccttacagggtgtgctctatggcccagggtaccgacctgatcaggtttgagagaaacattgtttgcacaagcatgaagcccatcaatgaggacttggatgagggcatcatggtggtttacaagagaaatatcgtggcccacaccttcaaagtgagggtgtatcagaaggtgctgacctttagaaggagctacgcttatatccacacaacctaccttctgggcagcaacaccgagtacgtcgcaccacccatgtgggaaattcaccacatcaactctcactcccagtgctattccagctacagcagagtgatagccggcacagtcttcgtggcctaccacagggatagttacgagaataagacgatgcaactgatgcctgacgattactccaacacacacagcacccggtacgtcaccgtgaaggaccagtggcactccagaggtagtacttggctgtaccgggagacttgtaacctgaactgcatggtgacaattaccactgctcgaagcaagtacccttaccacttctttgccacctctaccggcgatgtcgtagacatatctcctttctataacgggaccaacagaaacgcttcgtacttcggcgagaacgctgacaagttcttcatcttcccgaactacactatagttagcgactttggtaggccgaacagcgccctggagacacaccgacttgtggccttcctcgagagagctgacagcgtgatctcctgggacatccaggacgagaagaacgtcacctgccagctgacattctgggaggcctctgagaggaccatcagatccgaggccgaggattcataccactttagcagcgctaagatgaccgctaccttcctgagtaagaagcaggaagtgaacatgtccgactcagccctcgactgcgtgagggacgaggccatcaacaagctgcagcagatcttcaacacctcctacaaccagacatatgagaagtatggtaacgtgagcgtgttcgagacaaccggcggactggtcgtgttttggcagggcataaagcagaagtctctggtcgagctggagaggctggcgaacaggagcagcctcaacctgacccataacagaaccaaacgcagcaccgacggcaacaatgctacccacctgtcaaacatggagagcgtccacaacctggtgtatgcccagctgcaatttacatacgacacgctgcgcggctacatcaatagagccctggcccagatcgccgaggcttggtgcgttgaccagcggcgtactctggaagtcttcaaggagctgagcaagatcaatcccagcgctatcctgagcgcgatctacaataaacctattgctgccagattcatgggagacgtgttggggctggccagctgcgtgacaatcaatcagaccagcgtgaaagtgctgagagacatgaatgtgaaggagtctcctggtaggtgctactcaaggcccgtcgtaattttcaatttcgccaacagttcctacgtgcagtacggacagctgggcgaagacaatgagatcctcctgggcaaccatcggacggaggagtgtcaactcccatcactgaagatctttatcgcaggcaattccgcctatgagtatgtggactatctgttcaagaggatgatcgacctgtccagcatcagcacagtggattcaatgattgcccttgacatcgaccctcttgagaataccgactttagagtgctggagctttatagccagaaagagctcaggagctccaatgtgttcgacctggaagagatcatgcgggagtttaacagctacaagcagagggttaaatatgtggaggacaaggttgtggatccactgccgccctacctgaaagggctggacgacctcatgtccggcctaggagccgcagggaaagccgtgggcgtggccatcggcgcagttggaggcgccgtcgcctctgtggttgaaggcgttgcgacctttctgaagaacccattcggcgccttcaccattatcctggtggccattgccgtggtcatcatcacctatctgatctacaccaggcaacgacgcctgtgcacccagcccctgcagaacctgttcccttacctggtcagcgccgatgggaccacagtgacctctggttctactaaagacaccagccttcaggcccctccatcctacgaggagtctgtgtacaatagcggcagaaagggccccggcccgcccagcagcgatgccagcaccgccgctcctccatacacgaacgagcaggcctatcagatgctgctggcccttgcccgcctggacgccgagcagcgtgctcagcagaatggcaccgattctctggacggccgaactggaacgcaagacaagggacagaagccaaacctgctggacagactgagacacaggaagaatggctacaggcatctgaaggattcagacgaggaggagaacgtg

SEQ ID NO: 164 - DNA, 2721 bp, Artificial Sequence
  Synthetic polypeptide
atggagagccggatctggtgccttgtggtgtgcgtgaacctttgcatcgtgtgcctcggcgccgccgtgagctcatcgagcacccggggcaccagcgccacccacagccaccacagcagccacaccaccagcgcggcccacagtcggagcggcagcgtgagccagcgggtgacctcctcccagaccgtctcccacggcgtgaacgaaaccatctacaacaccaccctgaagtacggcgacgtggttggggtaaataccactaagtacccctaccgggtgtgcagcatggcccagggcaccgacctgatccggttcgagcggaacatcgtctgtaccagcatgaagcccatcaacgaggacctggacgagggcatcatggttgtctacaagcggaatatcgtagcccacaccttcaaggtgcgggtgtaccagaaggtgctgaccttccggcggagctacgcctacattcacacgacttacctgctgggcagcaacaccgagtacgtggcgccgcccatgtgggagatccaccacatcaactctcactctcagtgctacagcagctacagccgggtgatcgccggcaccgtgttcgtggcctaccaccgggacagctacgagaacaagaccatgcagctgatgcccgacgactattctaacacacactccactaggtacgtgaccgtgaaggaccagtggcactccagaggcagcacctggctgtaccgggagacgtgcaacctgaactgcatggtgaccatcaccaccgcccggtcaaagtacccttaccacttcttcgccaccagcactggggatgtggttgacatcagccccttctacaacggcaccaaccggaacgccagctacttcggcgagaacgccgacaagttcttcatcttccccaactacaccatcgtgagcgacttcggccggcccaacagcgccctggaaacacaccggctggtggccttcctggagcgggccgacagcgtgatcagctgggacatccaggacgagaagaacgtgacctgccaactcacattttgggaggccagcgagcggaccatccggagcgaggccgaggactcctatcacttcagcagcgccaagatgaccgccaccttcctgagcaagaagcaggaggtgaacatgagcgattcggcattggactgcgtgcgggacgaggccatcaacaagctgcagcagatcttcaacaccagctacaaccagacctatgagaaatacggcaacgtgagcgtgttcgaaaccaccggcggactggttgttttctggcagggtatcaagcagaagagtttggtggagctcgagcgcctggcaaacaggagcagcctgaacctgacccacaaccggaccaagcggagcaccgacggcaacaatgcaacgcacctatccaacatggagtccgtgcacaacctggtgtacgcccagctgcagttcacctacgacaccctgcggggctacatcaaccgggccctggcccagatcgccgaggcatggtgcgtggaccagcggcggaccctggaggtgttcaaggagctttccaagatcaacccctctgccatcctgtctgctatctacaataagccaatcgcggcacgcttcatgggagacgtactgggcctggccagctgcgtgactattaatcagactagcgtcaaagtgctacgggacatgaacgtaaaggagagccccggccggtgctattctcggcccgtggtcattttcaacttcgccaacagttcctacgtgcagtacggacagttaggcgaggacaacgagattctgctgggtaaccaccggaccgaggagtgccaacttcccagtctaaagatatttatcgccgggaattccgcttatgagtatgtcgactacctgttcaagcggatgatcgacctgtccagtatcagcaccgtggacagcatgattgcactggatatcgaccctctcgagaacaccgacttccgggtgctggagctgtacagccagaaagagctgagatcaagtaatgtctttgacctggaggagatcatgcgggagttcaatagctacaagcagagggtgaaatatgtcgaagacaaggtagtagacccgctgcctccctacctgaaggggcttgacgacctcatgtcagggttaggggcagctggcaaggccgttggcgtcgccatcggcgcggtgggcggtgccgttgcctccgtggtcgaaggcgtcgctaccttcctcaagaaccccttcggcgccttcaccatcatcctggtggctattgcagttgtcatcattacctacctcatctacacccggcagcggaggctgtgcacccagcccctgcagaacctgtttccatacctggtgagcgcagacggaactaccgtgacgagcggatccactaaggacaccagcctgcaggcgcctccttcatacgaagagagtgtgtacaacagcggccggaagggccccggacctccgagtagcgacgcaagtaccgccgccccaccctataccaacgagcaagcttaccagatgctgctggcacttgctcggctggacgccgaacaacgcgcccagcagaacggaactgattctctggacggccggaccggcacccaggacaagggccagaagcccaacctgttggaccggctgcggcaccggaagaacggctatcgtcacctgaaagacagcgacgaggaggagaacgtg

SEQ ID NO: 165 - DNA, 2721 bp, Artificial Sequence
  Synthetic polypeptide
atggagagccggatctggtgcctagtggtgtgcgtgaacctctgcatcgtgtgcctaggcgccgccgtgagcagttctagtacccggggcaccagcgccacccacagccaccacagcagccacactacgtcagcagcgcatagtcggagcggcagcgtgagccagcgggtgacgtcttcccagacagtgtcccacggcgtgaacgaaaccatctacaacaccaccctgaagtacggcgacgtggtgggtgtcaatacaactaagtacccctaccgggtgtgcagcatggcccagggcaccgacctgatccggttcgagcggaatattgtgtgtaccagcatgaagcccatcaacgaggacctggacgagggcatcatggtggtatacaagagaaacattgtcgcccacaccttcaaggtgcgggtgtatcagaaggtgctgaccttccggcggagctacgcctacattcatacgacttacctgctgggcagcaacaccgagtacgtggccccgcccatgtgggagatccaccacatcaacagccactcccagtgctacagcagctacagccgggtgatcgccggcaccgtgttcgtggcctaccaccgggacagctacgagaacaagaccatgcagctgatgcccgacgactatagcaatactcacagcacacggtacgtgaccgtgaaggaccagtggcacagccgcggcagcacctggctgtaccgggaaacgtgcaacctgaactgcatggtgaccatcaccaccgcccggtcgaagtatccctatcacttcttcgccaccagcacgggcgatgtggttgacatcagccccttctacaacggcaccaaccggaacgccagctacttcggcgagaacgccgacaagttcttcatcttccccaactacaccatcgtgagcgacttcggccggcccaacagcgccctggaaacccaccggctggtggccttcctggagcgggccgacagcgtgatcagctgggacatccaggacgagaagaacgtgacctgccagcttacattctgggaggccagcgagcggaccatccggagcgaggccgaggacagttaccacttctcgagcgccaagatgaccgccaccttcctgagcaagaagcaggaggtgaacatgagcgacagtgctctggactgcgtgcgggacgaggccatcaacaagctgcagcagatcttcaacaccagctacaaccagacctatgagaaatacgggaacgtgagcgtgttcgagacaaccggcggcttagtagtgttctggcaggggatcaagcagaagagtttggtggagctcgagcggctggcgaacagaagcagcctgaacctgacccacaaccggaccaagcggagcaccgacggcaacaacgcaacgcacttatcaaacatggaaagtgtgcacaacctggtgtacgcccagctgcagttcacctacgacaccctgcggggctacatcaaccgggccctggcccagatcgccgaggcgtggtgcgtggaccagcggcggaccctggaggtgttcaaggagttgtcgaagatcaacccttctgccatcctgtcagcaatttacaataaacctattgccgcaaggttcatgggagatgtcctgggcctggccagctgcgtgaccataaaccagacaagcgtcaaagtcctccgggacatgaatgtgaaagagagccccggccggtgttacagtcgacccgtggtgatctttaacttcgccaattcttcttatgtgcagtacggacagctcggcgaggacaacgagatcctgctcggtaaccaccggaccgaggagtgtcagcttccctcactgaagattttcattgcggggaacagtgcatacgagtatgttgactacctgttcaagcggatgatcgatctgtctagtatcagcaccgtggacagcatgatcgctctggatatcgacccattggagaacaccgacttccgggtgctggagctgtacagccagaaggagcttcgcagcagtaatgtgtttgacctggaggagatcatgcgggagttcaattcttacaagcagcgcgtgaaatacgttgaggacaaggtggtcgatccgctgcctccctacctgaagggcctggatgatctcatgagcgggttaggggctgccggcaaggccgtcggcgttgccatcggcgcagtgggcggagccgtcgccagcgtggtggagggtgttgcaacgttcctgaagaaccccttcggcgccttcaccatcatcttggttgcaatcgcggttgttatcattacctaccttatctacacccggcaacggcggctgtgcacccagcccctgcagaacctgtttccatacttggtgagcgcggatgggaccaccgtgacttcaggttccaccaaggacaccagcctgcaggcgcctccctcatacgaggagtccgtatacaacagcggccggaaggggccaggtcctcctagctcggacgcaagtactgccgcaccgccttataccaacgagcaggcatatcagatgctgcttgccctggctcggctggacgccgaacagcgcgcccagcagaacggaacagattccctggacggccggaccggcacccaggataagggccagaagcccaacttgctggaccggctgcggcaccggaagaacggctataggcatctgaaggacagcgacgaggaggagaacgtg

SEQ ID NO: 166 - DNA, 2721 bp, Artificial Sequence
  Synthetic polypeptide
atggagagccggatctggtgcctagtggtgtgcgtgaacctatgcatcgtgtgcttaggcgccgccgtgagctcatcgtccacccggggcaccagcgccacccacagccaccacagcagccacacgacaagcgccgcccactcccggagcggcagcgtgagccagcgggtgacttcttcccagacagtgagccacggcgtgaacgagactatctacaacaccaccctgaagtacggcgacgtggtgggcgtcaacactaccaagtacccctaccgggtgtgcagcatggcccagggcaccgacctgatccggttcgagcggaacattgtgtgcaccagcatgaagcccatcaacgaggacctggacgagggcatcatggttgtgtacaagcgtaatatcgtcgcccacaccttcaaggtgcgggtgtaccagaaggtgctgaccttccggcggagctacgcctacatccatactacgtacctgctgggcagcaacaccgagtacgtggctcctcccatgtgggagatccaccacatcaactcccatagccagtgctacagcagctacagccgggtgatcgccggcaccgtgttcgtggcctaccaccgggacagctacgagaacaagaccatgcagctgatgcccgacgactattcgaacacccactcaaccagatacgtgaccgtgaaggaccagtggcattcacggggcagcacctggctgtaccgggaaacatgcaacctgaactgcatggtgaccatcaccaccgcccggagtaaatacccttatcacttcttcgccaccagcacgggcgacgtcgtagacatcagccccttctacaacggcaccaaccggaacgccagctacttcggcgagaacgccgacaagttcttcatcttccccaactacaccatcgtgagcgacttcggccggcccaacagcgccctggagacacaccggctggtggccttcctggagcgggccgacagcgtgatcagctgggacatccaggacgagaagaacgtgacctgccagctgacgttttgggaggccagcgagcggaccatccggagcgaggccgaagattcctatcactttagcagcgccaagatgaccgccaccttcctgagcaagaagcaggaggtgaacatgtctgattccgcgctggactgcgtgcgggacgaggccatcaacaagctgcagcagatcttcaacaccagctacaaccagacctatgagaagtatgggaacgtgagcgtgttcgagacaaccggcgggctggtcgtcttctggcaaggcattaagcagaagtccctcgtggagctggaacggctggccaaccgtagcagcctgaacctgacccacaaccggaccaagcggagcaccgacggcaacaatgctactcatctatcaaacatggaaagcgtgcacaacctggtgtacgcccagctgcagttcacctacgacaccctgcggggctacatcaaccgggccctggcccagatcgccgaggcctggtgcgtggaccagcggcggaccctggaggtgttcaaggagctaagtaagatcaacccctccgcaatcctgagcgccatctataacaagcctatcgccgcccggttcatgggcgatgtgctgggcctggccagctgcgtcaccatcaatcaaactagcgtgaaggtcctacgggacatgaacgtgaaagagagccccggccggtgctactcccggcccgtggtcatcttcaatttcgccaactcttcctatgtgcagtacgggcagctgggcgaggacaacgagattctgctgggtaaccaccggaccgaggagtgccagcttccctccctcaagattttcatagcaggcaattctgcctatgaatacgttgactacctgttcaagcggatgatcgatctctctagtatcagcaccgtggacagcatgattgcgttggacatcgacccgttagagaacaccgacttccgggtgctggagctgtacagccagaaagaactgcgttcaagcaacgttttcgacctggaggagatcatgcgggagttcaactcttacaagcagcgggtcaagtacgtcgaggataaggtcgtggacccgctgccgccctacctgaagggactggacgatctgatgtccggattgggagctgcaggaaaggccgtgggagtagccatcggcgctgttggaggggcagtggccagcgtggtcgaaggcgtcgcgacgttcctgaagaaccccttcggcgccttcacaataatcttggttgccattgctgtcgtcattattacatatcttatctacacccggcagagaagactgtgcacccagcccctgcagaacctgttcccttatttggtgagcgccgacgggacaaccgtcacctccggctcaacgaaggacaccagcctgcaggctccgccttcatatgaagagtcagtatataacagcggccggaaggggccaggtcctccatctagcgacgcatcaactgccgcacctccgtacaccaacgagcaggcataccagatgctgttggccctcgcacggctggacgccgagcaacgcgcccagcagaacgggacggactctttggatggccggaccggcacccaagacaagggccagaagcccaatttgctggaccggctgcggcaccggaagaacggctatagacatctgaaggacagcgacgaggaggagaacgtg

SEQ ID NO: 167 - DNA, 2721 bp, Artificial Sequence
  Synthetic polypeptide
atggagagccggatctggtgcctagtggtgtgcgtgaacctatgcatcgtgtgccttggcgccgccgtgagctcgtccagtacccggggcacctccgccacccactcccaccactcctcccacactacaagcgccgcccactcgcgctccggctccgtctcccagcgcgtcaccagttcccagaccgtgagtcacggcgtcaacgaaaccatctacaacaccaccctcaagtacggcgacgtcgtgggcgtgaatacaaccaagtacccctaccgcgtctgctccatggcccagggcaccgacctcatccgcttcgagcgcaacatcgtctgcacctccatgaagcccatcaacgaggacctcgacgagggcatcatggtcgtgtataagcgaaatattgtggcccacaccttcaaggtccgcgtctaccagaaggtcctcaccttccgccgctcctacgcctacattcacacaacctacctcctcggctccaacaccgagtacgtcgcccctcccatgtgggagatccaccacatcaacagtcacagccagtgctactcctcctactcccgcgtcatcgccggcaccgtcttcgtcgcctaccaccgcgactcctacgagaacaagaccatgcagctcatgcccgacgactatagcaatacacatagtacccgctacgtcaccgtcaaggaccagtggcacagcaggggctccacctggctctaccgcgagacttgcaacctcaactgcatggtcaccatcaccaccgcccgctcaaagtacccgtatcacttcttcgccacctccacgggagacgtggtggacatctcccctttctacaacggcaccaaccgcaacgctagctatttcggcgagaacgccgacaagttcttcatcttccccaactacaccatcgtctccgacttcggccgccccaactccgccctcgaaacccacaggcttgtggccttcctcgagcgcgccgactccgtcatctcctgggacatccaggacgagaagaacgtcacctgccagctcacattctgggaggcctccgagcgcaccatccgctccgaggccgaggattcgtaccactttagctcagcaaagatgaccgccaccttcctctccaagaagcaggaggtcaacatgagcgactctgctttggactgcgtccgcgacgaggccatcaacaagctccagcagatcttcaacacctcctacaaccagacttatgagaagtatggcaacgtctcggtgttcgagactacgggcggtctggtggtcttctggcaggggattaagcagaagtccctcgtcgagttggagagactcgccaaccgctcctccctcaacctcacccacaaccgcaccaagcgctccaccgacggcaacaacgccacgcacctctcaaacatggagtccgtccacaacctcgtctacgcccagctccagttcacctacgacaccctccgcggctacatcaaccgcgccctcgcccagatcgccgaggcctggtgcgtcgaccagcgccgcaccctcgaggtcttcaaggagctcagtaagatcaacccaagtgcgatcctgtcggccatttacaataaaccgattgcagcccgcttcatgggtgacgtactcggcctcgcctcctgcgtgacgattaatcagaccagcgtcaaggtgcttcgcgacatgaatgtgaaggagagcccaggccgctgttacagtcggcccgtcgtcattttcaatttcgccaatagcagctatgtccagtacggccagctcggcgaggacaacgagatactccttggcaaccaccgcaccgaggagtgccagctgccgtctctgaagatattcatagccggcaacagcgcttatgaatacgtggactacctcttcaagcgcatgatcgacctctcctccatctccaccgtcgactccatgatcgcacttgatatcgacccactggagaacaccgacttccgcgttctggaactctactcccagaaggagctacggtcctccaatgttttcgacctcgaggagatcatgcgcgagttcaattcatacaagcaacgggtgaagtatgtggaggacaaggtcgtcgatcctctgcctccctacctcaagggtcttgatgatctcatgtccggcctcggcgctgccgggaaggcagtgggagtcgccatcggcgccgttggaggggccgtcgcctctgtggtggagggcgtggctaccttcctgaagaaccccttcggcgccttcaccattattctggtggccatcgcagtggttatcatcacgtaccttatctacacccggcagagaaggctctgcacccagcccctccagaacctctttccttatctcgtcagcgcagacggtacaacagttactagtggaagtaccaaggacacctccctccaggccccgccaagctacgaggaaagtgtttacaactccggccgcaagggccccggcccaccttcttccgacgcttccaccgctgctccaccatacaccaacgagcaggcctaccagatgctcctggcactggctcggctggatgccgagcagagggcccagcagaacggtaccgattccctcgacggccgcaccggcacccaggataagggccagaagcccaatttactagacagactgcgccaccggaagaacggctaccgccatctgaaggactccgacgaggaggagaacgtc

SEQ ID NO: 168 - DNA, 2721 bp, Artificial Sequence
  Synthetic polypeptide
atggagagccggatctggtgcctagtggtgtgcgtgaacctctgcatcgtgtgcttgggcgccgccgtgagtagttccagtacccggggcacctccgccacccactcccaccactcctcccacactacgagtgccgcccactcacgctccggctccgtctcccagcgcgtcactagttctcagacagtgtctcacggcgtcaacgagacaatctacaacaccaccctcaagtacggcgacgtcgtgggtgtgaatactactaagtacccctaccgcgtctgctccatggcccagggcaccgacctcatccgcttcgagcgcaacatcgtctgcacctccatgaagcccatcaacgaggacctcgacgagggcatcatggtcgtctacaagagaaatatagtggcccacaccttcaaggtccgcgtctaccagaaggtcctcaccttccgccgctcctacgcctacattcacactacctacctcctcggctccaacaccgagtacgtcgccccacccatgtgggagatccaccacatcaactctcacagtcagtgctactcctcctactcccgcgtcatcgccggcaccgtcttcgtcgcctaccaccgcgactcctacgagaacaagaccatgcagctcatgcccgacgactactcaaacactcacagcacccgctacgtcaccgtcaaggaccagtggcacagccgcggctccacctggctctaccgcgagacttgcaacctcaactgcatggtcaccatcaccaccgcccgctcgaagtatccgtaccacttcttcgccacctccacgggcgatgtggtcgacatcagtccattctacaacggcaccaaccgcaacgcttcatacttcggcgagaacgccgacaagttcttcatcttccccaactacaccatcgtctccgacttcggccgccccaactccgccctcgagacacaccgcctggtcgccttcctcgagcgcgccgactccgtcatctcctgggacatccaggacgagaagaacgtcacctgccagttgaccttctgggaggcctccgagcgcaccatccgctccgaggccgaggacagttaccatttcagtagtgccaagatgaccgccaccttcctctccaagaagcaggaggtcaacatgtcggactctgctcttgactgcgtccgcgacgaggccatcaacaagctccagcagatcttcaacacctcctacaaccagacttatgagaagtatggtaacgtctctgtgtttgagactacaggcggtcttgtcgtcttctggcagggtatcaagcagaagtccctcgtcgagctggaacgcctcgccaaccgctcctccctcaacctcacccacaaccgcaccaagcgctccaccgacggcaacaacgcaacacatcttagcaacatggagtccgtccacaacctcgtctacgcccagctccagttcacctacgacaccctccgcggctacatcaaccgcgccctcgcccagatcgccgaggcctggtgcgtcgaccagcgccgcaccctcgaggtcttcaaggagctgagtaagatcaacccaagtgcaatcctaagcgctatttacaacaaacctatcgcagccaggttcatgggagacgtcctcggcctcgcctcctgcgtcaccattaatcagacgtctgttaaggttctccgcgacatgaacgtgaaagagtctccgggccgctgctacagcaggcccgtcgtcatcttcaatttcgccaattcttcatatgtccagtacggccagctcggcgaggacaacgagattctcttagggaaccaccgcaccgaggagtgtcagctacccagcctgaagatctttattgccggcaatagcgcttatgagtatgttgactacctcttcaagcgcatgatcgacctctcctccatctccaccgtcgactccatgatcgctctggatatcgaccctctggagaacaccgacttccgcgtgcttgagctctactcccagaaagagcttaggtcaagcaacgttttcgacctcgaggagatcatgcgcgagttcaactcatataagcaacgcgttaaatatgtagaggataaggtggttgatccacttcctccctacctcaagggtctggatgacctcatgtccggcctcggggcagcaggcaaggccgtcggcgttgccatcggcgccgtgggaggtgctgtggccagtgttgtcgagggcgtagccaccttcttaaagaaccccttcggcgcctttacaataatcctggtggccatcgctgtggttatcattacctatcttatctacaccaggcagcggaggctctgcacccagcccctccagaacctcttcccttacctcgtgagcgcggacgggacgaccgtcacatctggcagtacaaaggacacctccctccaggccccgcctagttatgaagagagcgtttacaactccggccgcaagggccccggtcctccctcctccgacgccagcaccgcagcgcctccatacaccaacgagcaggcctaccagatgctcttggccctggcccgactggatgccgagcagcgcgcccagcagaacggaaccgactccctcgacggccgcaccggcacccaggacaaaggccagaagcccaatctgctcgaccgcctgcgacaccgcaagaacggctatcggcaccttaaagactccgacgaggaggagaacgtc

SEQ ID NO: 169 - DNA, 2226 bp, Artificial Sequence
  Synthetic polypeptide
atgcggccaggacttcctagctacctaatcatccttgccgtgtgtcttttctcacacctcctctctagtaggtacggcgcagaggccgtgtccgagccactcgacaaggccttccaccttttgttaaacacctacggtcggccaatcagattcctccgcgagaacaccacccagtgcacgtacaattcgtctctccgcaacagcacagtcgtgagggagaacgctatatcattcaacttcttccagtcttacaaccagtattacgtgttccacatgccaagatgcctgttcgctggcccactggccgagcagttccttaaccaggtggatctgacagagactctggagagataccaacagaggctgaacacctacgcactggtgagcaaggatctggcctcctacaggagcttcagccaacagctgaaggcccaggacagtctgggcgagcaaccaaccaccgtacctccacctattgacttatcaatacctcacgtgtggatgcctcctcagaccactcctcacggctggaccgaatcccacaccacctccggcctgcacaggcctcatttcaaccagacctgtattctcttcgacggacacgacctgcttttcagcaccgtcacgccatgcttgcaccagggcttctacctgatcgacgagctcaggtatgtgaagatcactctgaccgaggacttcttcgtggttactgtgagcatcgatgacgataccccaatgttactgatcttcggccacctgcctagggtgctgttcaaggcaccataccagagagacaatttcatcctgagacaaaccgagaagcacgagctgctggtgctggtcaagaaggaccagctgaataggcactcatacctgaaggacccagatttcctggacgctgcccttgatttcaattacctggacctgtccgccctgctgagaaacagcttccacagatacgccgtggatgtgctgaagtcaggcagatgtcagatgttggaccgccgaaccgttgagatggccttcgcctacgcgctggccctgttcgccgccgctcggcaggaggaagctggcgcacaggtgagcgtgccgagggctctggaccgacaggctgctctgctacagattcaggaattcatgatcacctgcctgtcacagactccgcctcggactaccctgctgctgtatcctacagcagtggacctggcaaagagagctctttggacccctaaccagatcaccgatatcaccagcctcgtccggctggtctacattctgtctaagcagaatcagcagcacctgatccctcagtgggctctcagacagatcgccgatttcgccctgaagctgcacaagacccacctggcttctttcctgagcgctttcgccagacaggaactgtacctgatgggatcgcttgtgcacagcatgctggtgcacacaactgagaggagagagattttcattgtggagactggcctgtgcagcctggccgagctgtcccatttcacccagctcctcgctcatccgcaccacgagtacctctccgacctctataccccttgctcctcttccggccggcgcgatcacagcctggaaagactcactagactgttcccagacgctaccgtgccggctactgtcccggcagcactgagcatcctgagcactatgcagccttctacgctggaaaccttcccggacctgttctgcctgccactcggagaaagcttctctgccctgacggtgagtgagcacgtgtcgtacatcgtgacaaaccagtacctgatcaagggtatcagctacccagtgtccacaactgtggtgggccagagcctgatcatcacccagaccgatagccaaacaaagtgcgaactgacaagaaacatgcataccactcattccatcactgtggccttaaacatctccctggagaactgcgccttctgtcagtccgccctgctggagtacgatgatacccagggcgttattaatatcatgtacatgcatgatagcgacgatgtgcttttcgccctggacccatacaacgaggtggtggtgtccagccctagaacccactacctcatgctgctgaagaacggcacagtgctggaggtgaccgacgtggtggtggacgctacggacagcaggctgctgatgatgagcgtgtacgccctgagcgccattatcggaatatacctgctgtacaggatgttgaagacctgt

SEQ ID NO: 170 - DNA, 2226 bp, Artificial Sequence
  Synthetic polypeptide
atgcggccgggactccctagctacctcatcatcctcgccgtgtgccttttctctcaccttttgagctccagatacggcgccgaagcggtgtccgagcctctcgacaaggccttccacctccttctcaacacatacggcagaccgatccggttcttgagggagaacactacccaatgcacatataacagtagcctgcggaatagcactgtggtgcgggagaacgccatcagcttcaatttcttccagagctacaatcagtattacgtgttccacatgcctagatgtctgttcgcgggccctctggcagagcagttcctgaaccaggttgatctcacagagacactggagagataccagcaaagactgaacacctacgctctcgtctccaaggacctggccagctataggagcttcagccagcagctgaaggcccaggattccctgggagagcagccaaccaccgtcccgccgccaatcgacctctctatcccacacgtgtggatgcctccacaaaccacaccacacggatggactgagtcccataccaccagcggactgcacaggcctcacttcaatcagacctgcattttgttcgacggccacgacctcctgttcagcactgtgaccccgtgtctgcatcagggcttctacctgattgacgagctgaggtacgtcaagattacgctcaccgaagacttcttcgtggtcacagtgagtatcgatgacgacacccctatgctgctcatcttcggccatctgcctagggtgctgttcaaggccccttaccagagagataatttcatcttgcggcagactgagaagcacgaactgctggtactcgtgaagaaggaccagctgaaccgccactcttacttaaaggatccagacttcctggatgcagcacttgacttcaactatctcgacctctctgccctgctgaggaacagcttccaccggtatgccgtggacgtgctgaagagtggacggtgtcagatgctggaccgcagaacagtggaaatggcgttcgcgtatgctctggccctattcgcggccgcaagacaggaggaggccggcgctcaggtgtccgtccctagagctctggacaggcaggccgccctgctgcaaattcaggagttcatgataacttgcctgagccaaacccctccgagaacaacactgctgctgtatccaacagccgtagatctggccaagcgggccctttggactcctaaccagatcaccgatattacctccctggtgagactggtgtacattctgtccaagcagaaccagcagcacctgatcccgcagtgggccctgagacagatcgctgatttcgccttgaagctgcacaagactcatctggcctccttcctgagtgctttcgcccgccaggaactgtatctgatgggctctcttgtccattccatgctggttcataccacggagagaagggagatcttcatcgtggaaaccggcctttgctccctcgctgagctgagccatttcactcagctgctcgcccacccgcaccacgagtacctgtcagacctttatactccgtgctcctccagcggcaggagggaccacagcctggaacggctcacaagactgttcccggatgctaccgtgcctgctactgtgccagccgccctgagcatcctttccaccatgcagccttccacactggagactttccctgacctgttctgcctgccacttggcgaaagtttcagcgccctgaccgtgtccgaacatgtgagctacatcgtgactaaccagtacctgatcaagggcatcagctacccggttagcaccactgtcgtcggacagtcactgatcatcactcagaccgactcccagaccaagtgcgaactgaccagaaatatgcacacaacccatagcatcaccgtggccctgaacattagcctggagaactgtgccttctgccagagcgccctcctcgagtacgacgatacccagggtgtgataaacattatgtatatgcacgacagtgacgacgttctgttcgcactggacccttacaacgaagtggtcgtttcctctcctcggacccattacctgatgctgctgaagaacggcaccgtgctagaggttactgatgtggtagtggacgccacagacagcagactgctgatgatgagcgtgtacgccctgagcgccattattggcatctacctgctgtacaggatgctgaagacatgt

SEQ ID NO: 171 - DNA, 2226 bp, Artificial Sequence
  Synthetic polypeptide
atgcggccgggactcccttcctacctcatcatccttgccgtgtgtcttttctcacacctcctcagcagccgctacggcgccgaggccgtgtcagagccacttgacaaggccttccatcttttgttgaacacctacggcagacctattcggttcctgagagagaacacaacccagtgcacctataacagctctctgcgcaactccacagtggttagagagaatgccatcagcttcaacttcttccagagttacaaccagtattacgtgttccatatgcctaggtgcctgttcgctggcccgttagccgaacagttcctcaaccaggtggatctgaccgaaacactggaaaggtaccagcagcggctgaatacatacgccttggtgtcaaaggatcttgcttcctacagaagcttcagccagcagctgaaggcccaggacagccttggagagcagccaaccaccgtgcctcctcctattgacctgagcatccctcatgtgtggatgcctcctcagaccacccctcacggctggactgagagccataccacgtccggcctgcacaggcctcacttcaatcagacctgcatcctgttcgacggccacgatctgcttttcagcaccgtcaccccttgcctgcaccagggattctacctgatcgacgagctccggtatgtgaagattacactgaccgaggacttcttcgtggtgaccgtgtccatcgacgatgacaccccaatgctgctgatcttcggccacctgccgagagtcctgttcaaggccccataccagagagacaacttcatcctgcggcagaccgagaagcacgaactgctagtgctggtgaagaaggatcagctgaaccggcactcctacctgaaggaccctgacttccttgacgccgcactcgacttcaactacctggacctcagtgctctactgaggaactctttccaccggtacgccgtggacgtgctgaagtctggaagatgccagatgctggataggaggacagtggagatggcgttcgcgtacgccctggccctgttcgccgccgccagacaggaggaggccggcgcacaggtcagcgtcccaagggccctggaccgccaggctgccctgctgcagattcaggaattcatgatcacctgtctcagccagacccctccgagaacaaccctgctgttgtacccgaccgcagtggatctggctaagagggccctgtggaccccaaaccagattaccgacatcacctctctggtgagactggtgtacatcctgtccaagcagaaccaacagcacctcattccacaatgggccctgaggcaaatcgccgatttcgctctcaagttgcataagacccatctggcctcattcctcagcgccttcgcaagacaggagttgtatctcatgggctccctcgtgcatagcatgctggtgcacacaaccgagcgcagagaaattttcatcgttgaaaccggactgtgcagcctcgccgagttgtctcatttcacccagctgctggctcatcctcaccatgagtatctttccgacctgtacaccccgtgcagcagcagcggccgcagggatcacagcctcgagagactgacaagactgttcccagacgccaccgtgcctgccacagtgccagccgcgctgtccatcctgagcacaatgcagcctagcacactggagactttcccagatctgttctgtcttccactgggcgagagcttcagcgccctgaccgtgagcgagcacgtgagctacatagtgaccaaccaatatttgattaagggcatctcctaccctgtgagcaccacagtggtgggccagtctctgatcatcacacaaaccgacagtcagacgaagtgcgagctgactagaaacatgcacacgacccacagcataaccgtggcactcaacatctccctggagaattgcgccttctgccagagcgccctcctggagtacgacgacactcaaggagtgatcaacatcatgtacatgcacgatagcgatgacgtgctgttcgccctggacccatacaatgaagtggtggtgtccagcccacggacccactacctgatgctcctcaagaacggcacagtgctggaggttacagacgtggtggtcgacgctaccgatagcagacttcttatgatgtccgtgtacgccctgagcgccatcatcggaatctatctgctttacaggatgctgaagacttgc

SEQ ID NO: 172 - DNA, 2226 bp, Artificial Sequence
  Synthetic polypeptide
atgcggccaggcctcccttcgtaccttatcatcttggccgtgtgtcttttctctcacctactctcctcaaggtacggcgccgaggccgtgagtgagccgctagacaaggccttccacctattacttaacacctacggccggcctatccgattcctccgggagaataccacacagtgtacatacaactctagcctgcgcaacagcactgtggtcagggagaacgccatcagcttcaatttcttccagagttataaccagtactacgtgttccacatgccaagatgcctgttcgccggacctcttgccgagcagttcctgaaccaggtggatctgaccgagacactggagagataccagcaaaggctcaatacctacgctttagtgagcaaggaccttgcttcttacagatctttctcacaacagcttaaggcgcaggacagcctcggcgagcagcctaccaccgtgcctcctcctattgacttgagcatcccacacgtatggatgcctccacagacgacaccacacggctggaccgaatcccatacaaccagcggactccaccggcctcatttcaatcagacctgcatccttttcgacggccatgacctgctattctctaccgtcaccccgtgcctgcaccagggcttctaccttatcgacgaactgagatacgtcaagatcacgctgaccgaagacttcttcgtcgttacagtcagcatcgacgacgatacccctatgctgctgatattcggccaccttcctagagtcctgttcaaggcaccgtaccagagggacaacttcatcctgagacagacagagaagcacgagctcctggtgctggtgaagaaggatcagctgaatagacacagttacctgaaggatccagacttcctggacgccgcactggacttcaactatctggatctgagcgccctgcttcgcaatagcttccatagatacgctgtggacgtgctgaagtctggccggtgtcagatgctggatcgtaggaccgtggagatggccttcgcctacgcactcgctctgttcgccgccgctagacaggaggaggccggagcccaagtgagtgtgcctcgggcactggacagacaggcagccttactgcagatccaggagttcatgattacctgcctgtctcagactccaccacggaccacccttctgctgtatcctaccgcggttgatctggctaagagggccctgtggacccctaaccagatcactgacatcaccagcctcgtgaggctggtgtacattcttagcaagcagaaccagcagcacctaatacctcagtgggccctgcggcagatcgccgacttcgccctgaagctgcacaagacccacctggcaagcttcctgtccgccttcgcccgccaggagctgtacctcatgggaagtctggtacactccatgctggtgcacaccaccgagagaagagagatcttcatcgtagaaaccggactctgctcactggccgaattgtcacacttcacccagctgctggcccatcctcatcacgagtatctgtccgacctgtacaccccttgcagctctagcggcaggcgggaccattccttggagaggctgaccaggctgttcccggatgccaccgttccagcaacagtgcctgcagccctgagcattctgtcaacaatgcagcctagcaccctcgaaactttcccggatctgttctgcctgcctcttggtgagagcttcagcgccctgaccgtgtccgagcatgtgtcttatatcgtaaccaatcagtacctgatcaagggcatcagctaccctgtgtccacaactgtcgtgggccaaagcctcatcataacccagaccgattcccagacaaagtgtgaactgacccgcaacatgcacaccactcacagcattactgtggccctgaacatctccctggagaactgtgccttctgtcagagcgcgcttctggagtatgatgacacccagggtgtgattaatatcatgtacatgcacgacagcgacgatgtgctgttcgcgctggatccttacaatgaggtggtcgtgagctcccctagaacccactatctcatgctgttaaagaacggcaccgtcctggaggtgacagacgtggtggttgatgccaccgacagcaggctgctgatgatgagcgtttatgccctgagcgccatcatcggcatttacctcctgtacaggatgttaaagacttgt

SEQ ID NO: 173 - DNA, 2226 bp, Artificial Sequence
  Synthetic polypeptide
atgcggccaggactccctagctacctcattatcctcgccgtgtgccttttctctcacctcttaagctcccggtacggcgccgaagccgtgagcgagccgcttgacaaggctttccacctcctccttaacacctacggcagacctattagattcctgagagagaacaccacccagtgtacatataattctagcctgcggaactccaccgtagtgagggagaatgccattagcttcaacttcttccagagctacaaccagtactatgtgttccatatgccgagatgtctgttcgctggacctctcgcagaacagttcttgaaccaggtggatctgactgaaactctcgagcggtaccagcaaagactgaatacctatgccttggtaagcaaggatctggctagctacaggagcttctcccagcagctcaaggcccaggactcccttggcgaacagcctaccaccgtccctcctccaattgacctgagcattccgcacgtgtggatgcctcctcagaccaccccacacggctggacagagtctcataccaccagcggactgcatagaccgcatttcaaccagacttgcatcctgttcgatggacatgatctcctgttctctacagtgactccatgcctgcaccagggcttctacctgatcgatgagctcagatacgtcaagatcaccttgaccgaagatttcttcgtggtcacagtgagcattgacgacgacaccccaatgcttctgatattcggtcacctgcctagggtcctcttcaaggctccataccagagagacaatttcatccttagacagaccgagaagcacgagctgctcgtgctggtgaagaaggatcaactgaacagacatagctacctaaaggatccggatttcctggacgccgctctggacttcaactacctcgacctcagcgccctgctgaggaacagcttccaccggtatgcagtcgatgttctcaagtccggcagatgccagatgctggaccgtagaactgtggagatggccttcgcctatgctctggccctgttcgccgccgcacgccaggaagaggctggagcccaggtgagcgtcccacgggctctggacagacaggctgctctgctgcagatccaagagttcatgattacctgtctgagccagacccctcctagaaccaccctcctcctctatccgaccgctgtggacctggccaagagagccttgtggacccctaatcagattactgacatcacaagcctggtcagactggtgtatatcctgagcaagcagaatcagcagcacctcattccacagtgggcgctgcggcagatcgctgatttcgccctgaagctgcacaagacccacctggccagcttcttgagcgcattcgcacggcaggaactctacctgatgggctctctggtgcacagcatgctcgtccacaccacagaacggcgagagatattcatcgttgagacaggcctgtgctctctggccgagttgtcccacttcacccaactgctggctcaccctcatcacgagtacctcagcgacctgtacaccccttgctcctccagcggtagacgggatcacagcctggaaagactgaccagactgttcccagacgccacggtccctgcaaccgtgcctgccgctctttcaatcttgtccaccatgcagcctagtacactggaaacattccctgacctcttctgcctgcctctcggagagtccttctcagccctgaccgtgagcgaacacgtgtcctacatcgtgaccaaccagtacctgatcaagggcatctcctaccctgtgtcgaccaccgtcgtgggccagagcctgatcattacacagacggactctcagaccaagtgcgagttgacacggaacatgcacaccacacacagcatcactgtggccctgaatattagcctcgagaactgcgccttctgccagagtgccctgctagagtatgatgatacacagggcgtgattaatatcatgtatatgcacgactctgatgacgtcctgttcgccctggacccatacaacgaggtggttgtgagctcccctcggacccactatctgatgctgctcaagaacggcactgttctcgaggtgacagatgtggtggtcgatgccacagattctcggctgctgatgatgagcgtgtacgctcttagcgccatcatcggaatctacctcctgtacaggatgctgaagacttgt

SEQ ID NO: 174 - DNA, 2226 bp, Artificial Sequence
  Synthetic polypeptide
atgcggccgggcctcccgtcttacctcatcatcttggccgtgtgcctcttctcccacctcttgagctcccggtacggcgcagaggccgtgtcagagcctctcgacaaggccttccatttgctccttaacacatacggcaggccaatcaggttcctgcgagagaataccacacaatgcacctacaactccagcttgaggaatagcaccgtggtgcgggagaacgccatctccttcaatttcttccagtcctacaatcagtattatgtgttccatatgcctaggtgtctcttcgcaggcccacttgccgaacaattcctgaaccaagtggacctgacagagacactggagagataccagcaacggctgaatacctacgccttggtgagcaaggatctcgccagctacagatctttctcacaacaactgaaggcccaggattctctcggtgagcagccaacgactgtgcctcctccaattgacctgtctatcccacatgtgtggatgccacctcagactacccctcacggatggacagagtctcataccactagcggcctgcacaggcctcacttcaatcagacctgtatcctcttcgacggtcacgatctgttgttcagcaccgtgaccccatgcctgcatcagggcttctacctgattgacgagctgagatatgtgaagataacactgaccgaggatttcttcgtggtcaccgtgagcatagacgacgacacaccgatgctcctgatcttcggccatctgccacgagttctgttcaaggcaccttatcagagagacaacttcatcttgaggcaaacagagaagcacgagcttctcgtgctggttaagaaggaccagctcaacaggcatagctacctgaaggacccagatttcctggacgccgctctggatttcaattatctggacctttctgctctgctgagaaacagcttccatagatacgccgtggacgtccttaagtctggccgctgccagatgctggatagacggactgtcgagatggcattcgcctacgctctggctctgttcgccgccgccaggcaggaggaggctggagcccaagtgtcagtgcctagggctctggatagacaagccgccttgctccagatccaggagttcatgattacctgtctgagccagaccccaccaagaaccacgttactgctgtaccctaccgctgtggacctggctaagcgagccctctggacgcctaatcaaatcaccgacatcaccagcttagtcagactggtgtacattctgtctaagcagaaccagcagcacttgattccacagtgggccctgagacagattgccgacttcgccctgaagctccataagacccatctggcgtccttcctgagcgccttcgccagacaggagctctacctgatgggcagcctggttcattccatgctggtccatacaacggagagaagagagatcttcatcgtggagacaggactgtgctctttggccgaactttcccacttcactcagctgctggcgcaccctcatcacgagtacttatcggacctgtacaccccttgcagcagcagcggaaggagggaccattctctcgaaaggctgacaagactgttccctgacgccaccgtcccagccacagtgcctgccgcactgagcatcctcagcacaatgcagccaagcactctggagactttcccggacttgttctgcctgccgctgggcgagtccttcagcgcccttacagtgtcagagcatgtgtcctacatcgtgaccaatcagtacctgatcaagggaatcagctaccctgtgtctacaaccgtggttggccagtccctcatcatcacccagacagatagccaaactaagtgcgaactgactagaaacatgcacacaacccactccatcacagtggccctgaacatcagcctcgagaattgcgccttctgccagagcgcactgttggagtacgacgatactcagggcgtgattaacatcatgtacatgcatgatagcgacgatgtgctgttcgccctggacccttataacgaggtggtggtgagtagtcctaggacccattaccttatgctgctgaagaacggaactgttctggaggttaccgacgtcgtcgttgacgctaccgactcacgcctgctcatgatgtctgtgtatgccctgtctgccatcatcggcatctacctgctgtataggatgctgaagacttgc

SEQ ID NO: 175 - DNA, 2226 bp, Artificial Sequence
  Synthetic polypeptide
atgcggcccggccttcccagctacctcatcatcctcgccgtgtgcttgttcagccaccttctaagcagccggtacggcgccgaggccgtgagcgagcccctcgacaaggccttccacttgttattgaacacctacggccggcccatccggttcctgcgggagaacaccacccagtgcacctacaacagcagcctgcggaacagcaccgtggttcgggagaatgccatcagcttcaacttcttccagagctacaaccagtactacgtgttccacatgccccggtgtcttttcgccggaccgctggccgagcagttcctgaaccaggtggacctgaccgaaactctggagcggtaccagcagcggctgaatacctatgccctggtgagcaaggacctggcctcataccggagcttcagccagcagctgaaggcccaggacagcctgggcgagcagcccaccaccgtgcctccacccatcgacctgagcatcccgcacgtgtggatgcctccacagaccacacctcacggctggaccgagagccacaccaccagcggcctgcaccggccccacttcaaccagacctgcatcctgttcgacggccacgacctgctgttcagcacagttaccccttgccttcatcagggcttctatcttatagacgagctgcggtacgtgaagatcacactcaccgaggacttcttcgtggtgaccgtgagcatcgacgacgacactcctatgctcctcatcttcggccatcttccccgggttctgttcaaggctccataccagcgggacaacttcatcctgcggcagaccgagaagcacgagttgctggtgctggtgaagaaggaccagctgaaccggcattcgtaccttaaggaccccgacttcctggacgccgccctggacttcaactacctagatctcagcgccctgttgaggaatagcttccaccggtacgccgtggacgtgttaaagagcggccggtgccagatgctggatcggcggaccgtggagatggccttcgcctacgcgctggccttgttcgctgccgcccggcaggaggaggccggcgcccaggtgagcgtaccgcgggcactcgatcggcaggccgctctgctgcagatccaggagttcatgatcacctgcctgagccagacccctccgcggaccaccttactgctttaccccactgcagttgacctggctaagcgcgcactctggacccctaaccagatcaccgacatcaccagcctggtgcggctggtgtacatcctgagcaagcagaaccagcaacacctgataccacagtgggctctgagacagatcgccgacttcgccctgaagctgcacaagacccatctggccagcttcctgtccgctttcgcacgacaggagctgtacctgatgggatcactcgtgcacagcatgctcgtgcataccaccgagcggcgggagatcttcatcgtggaaacaggcctgtgttcactagccgaactgagccacttcacccaacttttggcccatccacaccacgagtatttgtcggacctgtacaccccttgttcctcttccggaaggcgggaccactccctggaacggctgacccggctgttccccgacgcaaccgtaccggccacggttccagctgccttaagcatcttaagtaccatgcagcccagcacactggaaaccttcccagatctgttctgcctgccgctgggtgagtctttcagcgctctcaccgtgtccgagcacgtgagctacatcgtgacaaatcaatatctgattaagggcatcagctacccagtgtcaactacggtggttggccagagcttgattataacccagaccgactcgcagactaagtgcgagcttacgagaaacatgcacacaacccacagcatcaccgtggccctgaacataagtctggagaactgcgccttctgccagtctgccttgctcgagtatgatgacacccagggcgtgatcaacatcatgtacatgcatgacagcgacgatgttctcttcgcgttggatccatacaacgaggtggtggtgtccagtccgagaactcactatctgatgctcctaaagaacggcaccgtgctggaggtgaccgacgtcgtggtcgatgccacggactccagactgcttatgatgagcgtgtacgccctaagcgccatcatcggcatctatctcctgtatcggatgcttaagacctgc

SEQ ID NO: 176 - DNA, 2226 bp, Artificial Sequence
  Synthetic polypeptide
atgcggcccggccttcccagctacctcatcatcctcgccgtgtgcttgttcagccacttgcttagcagccggtacggcgccgaggccgtgagcgagcccttggacaaggccttccacttactcctcaacacctacggccggcccatccggttcctgcgggagaacaccacccagtgcacctacaacagcagcctgcggaacagcaccgtggtgcgtgagaacgccatcagcttcaacttcttccagagctacaaccagtactacgtgttccacatgcccaggtgccttttcgccggaccactggccgagcagttcctgaaccaggtggacctgaccgaaacactggagcggtaccagcagaggctgaacacatacgccctggtgagcaaggacctggcctcctaccggagcttcagccagcagctgaaggcccaggacagcctgggcgagcagcccaccaccgtgccgccacccatcgacctgagcatcccacacgtgtggatgccaccacagaccacccctcacggctggaccgagagccacaccaccagcggcctgcaccggccccacttcaaccagacctgcatcctgttcgacggccacgacctgctgttctcgaccgtcaccccttgcttgcaccagggcttctatctgatagacgagctgcggtacgtgaagatcaccttgaccgaggacttcttcgtggtgaccgtgagcatcgacgacgacacacctatgctgctcatcttcggccatttaccccgggttctgttcaaggcaccataccagcgggacaacttcatcctgcggcagaccgagaagcatgagcttctggtgctggtgaagaaggaccagctgaaccggcactcatatctgaaggaccccgacttcctggacgccgccctggacttcaactacctggatttaagcgccctgctccgtaactctttccaccggtacgccgtggacgtgttaaagtcaggccggtgccagatgttggaccggcggaccgtggagatggccttcgcttacgcattagccctcttcgcagccgcccggcaggaggaggccggcgcgcaggtgagcgtgcctagagcgttggatagacaggcggccttgctgcagatccaggagttcatgatcacctgcctgagccagactcctccacggaccacattgctgctctaccccaccgccgttgacctggcaaagcgggcgctctggactccgaaccagatcaccgacatcaccagcctggtgcggctggtgtacatcctgagcaagcagaatcagcagcacctgataccacagtgggcactacgccagatcgccgacttcgccctgaagctgcacaagacccacctggccagcttcctgtctgctttcgcaaggcaggaactgtacctgatgggctctctagtgcacagcatgctcgtccataccacagagcggcgggagatcttcatcgtggagactggcctgtgctctcttgcggaactgagccacttcacccagctcctagcccacccacaccacgagtacctttctgacctgtacaccccgtgctcatcaagtggacggcgggaccactcgctggaaagactcacccggctgttccccgacgctactgtgccggcaactgtgcctgcggctctctctatattatctaccatgcagcccagcacactcgaaaccttccctgatctgttctgcctgcctctaggagagagcttctctgcccttacagtgtccgagcacgtgagctacatcgtgacaaaccaatacctcattaagggcatcagctaccctgttagtactaccgtcgtaggccagagcctaattatcacccagaccgactcccagacaaagtgcgaattaacgcgcaacatgcacacaacccacagcatcaccgtggccctgaacattagcctcgagaactgcgccttctgccagagtgccttgcttgagtatgatgatacccagggcgtgatcaacatcatgtacatgcacgacagcgacgatgtgctgttcgcactcgacccctacaacgaggtggtcgtaagcagtccaaggacccattatttgatgctgcttaagaacggcaccgtgctggaggtgaccgacgtggtggtagacgctacagactcccggctgcttatgatgagcgtgtacgcgctcagtgcgatcatcggcatctacctgctttatcggatgctaaagacctgc

SEQ ID NO: 177 - DNA, 2226 bp, Artificial Sequence
  Synthetic polypeptide
atgcggcccggcttgcccagctacttgatcatcttggccgtgtgcttgttcagccacttacttagcagccggtacggcgccgaggccgtgtccgagcccctcgacaaggccttccacctcctcctcaacacctacggccgccccatccgcttcctccgcgagaacaccacccagtgcacctacaactcctccctccgcaactccaccgtcgtgcgggagaatgccatctccttcaacttcttccagtcctacaaccagtactacgtcttccacatgccccgctgcctcttcgccggacctctcgccgagcagttcctcaaccaggtcgacctcaccgagacgctcgagcgctaccagcagaggttgaatacctatgccctcgtctccaaggacctcgcctcctaccgctccttctcccagcagctcaaggcccaggactccctcggcgagcagcccaccaccgtgcctccaccaatcgacctctccatcccgcacgtctggatgcctccccagaccactccgcacggctggaccgagtcccacaccacctccggactgcatcgccctcacttcaaccagacctgcatcctcttcgacggccacgacctcctcttcagtaccgtgacgccatgcctgcaccagggcttctacctcatcgacgagctccgctacgtcaagatcacccttaccgaggacttcttcgtcgtcaccgtctcgattgacgacgacacaccaatgctcctcatcttcggccacctcccgcgcgtgctgttcaaggcgccctaccagcgcgacaacttcatcctgaggcagaccgagaagcacgagctgctcgtcctcgtcaagaaggaccagctcaaccgccactcctacctcaaggaccccgacttcctcgacgccgccctcgacttcaactacctcgatctgagtgctctgctgaggaattcattccaccgctacgccgtcgacgtcctcaagtccggccgctgccagatgctcgaccgccgcaccgtcgagatggccttcgcttacgcgctggcactcttcgctgccgcccgccaggaggaggccggcgcccaggtcagtgtgccaagagcactggatagacaggccgcacttttgcagatccaggagttcatgatcacctgcctctcccagactccgcctcgcaccacgttgttgttgtaccccacagcagtcgatctggctaagagagccttatggacacctaaccagatcaccgacatcacctccctcgttcggctggtctacatcctctccaagcagaatcagcagcacctgatccctcagtgggcactccgtcaaatcgccgacttcgccctcaagctccacaagacccacctggcgtctttcctcagtgcattcgctaggcaggagctgtacctgatgggcagtctcgtccactccatgctggtgcacaccacggagcgccgcgagatcttcatcgtcgagactggcctctgtagtttagccgagctcagtcacttcacccaactgctcgcccaccctcaccacgagtaccttagtgacctctataccccttgctctagttccggtcgccgcgaccacagcctggaacgtctgacccgcctcttccccgacgctacagtaccagcaaccgtgccagcggccctgtctatcctgtctaccatgcagccctccaccttggagacgttcccagatctgttctgcctccctctaggcgaatcgttctctgcactcacggtcagcgaacacgtctcctacatcgtcacaaaccagtatctgataaagggcatctcctacccagtgtcgaccactgttgtcggccagtccctcatcatcacacagactgattctcagactaagtgcgagttgacacggaacatgcatactacacattctatcaccgttgctttaaacataagcctggagaactgcgccttctgccagtccgctctgctcgagtacgacgatacgcagggcgtcatcaacatcatgtacatgcacgactccgatgacgttctgttcgcactggacccctacaacgaggtcgtcgtctcctctcctaggactcactacttaatgctgttgaagaacggcaccgtcctcgaggtcaccgacgtggtcgtcgatgctacagacagccgactgctcatgatgtccgtgtacgctctctccgccatcatcggcatctacctgctctaccgcatgctcaagacctgc

SEQ ID NO: 178 - DNA, 2226 bp, Artificial Sequence
  Synthetic polypeptide
atgcggcccggcctacccagctaccttatcatcttagccgtgtgcttgttcagccacttgctcagcagccggtacggcgccgaggccgtgtccgagcccctcgacaaggccttccacctcctcctcaacacctacggccgccccatccgcttcctccgcgagaacaccacccagtgcacctacaactcctccctccgcaactccaccgtcgtcagagagaatgccatctccttcaacttcttccagtcctacaaccagtactacgtcttccacatgccccgctgcctcttcgccggcccactcgccgagcagttcctcaaccaggtcgacctcaccgaaactctcgagcgctaccagcagcggctgaatacgtatgccctcgtctccaaggacctcgcctcctaccgctccttctcccagcagctcaaggcccaggactccctcggcgagcagcccaccaccgtccctcctccaatcgacctctccatcccacacgtctggatgcctccccagaccactcctcacggctggaccgagtcccacaccacctccggcctccacaggccacacttcaaccagacctgcatcctcttcgacggccacgacctcctcttcagcacagtgacgccatgtctgcatcagggcttctacctcatcgacgagctccgctacgtcaagatcactctgacggaggacttcttcgtcgtcaccgtctctatagatgacgacaccccaatgctcctcatcttcggccacttgcctcgcgtgctgttcaaggctccctaccagcgcgacaacttcatcctccgccagaccgagaagcatgaattactcgtcctcgtcaagaaggaccagctcaaccgccactcctacctcaaggaccccgacttcctcgacgccgccctcgacttcaactacctggatcttagcgccctgctgcgtaacagcttccaccgctacgccgtcgacgtcctcaagtccggccgctgccagatgctcgaccgccgcaccgtcgagatggccttcgcctatgctctggccctgttcgctgccgcccgccaggaggaggccggcgcccaggtttccgttcctcgggctttagacagacaggctgccctgcttcagatccaggagttcatgatcacctgcctctcccagacgccaccacgcaccacactgttgctgtacccgacagcagtggacctggcaaagagggcactctggactccaaaccagatcaccgacatcacctccctcgtccgcctcgtctacatcctctccaagcagaaccagcaacacctgatacctcagtgggctctgcggcagatcgccgacttcgccctcaagctccacaagacccatttggcctccttcctgagtgccttcgctagacaggagctgtacctgatgggctccctggtgcactccatgctggttcacaccacagagcgccgcgagatcttcatcgtcgagacaggcctctgttcattggcagaactctcgcatttcacccagctgctggcccacccgcaccacgagtatctgagtgacctctacacaccatgcagttcgtcaggaaggcgcgaccacagcctggagcgactgacccgcctcttccccgacgcaacagtccctgctactgtccctgccgcgctgagtattttatcaacgatgcagccctccacgctcgaaaccttccctgacttgttctgcctccctcttggagagagtttcagtgccctgaccgtgtcagagcacgtctcctacatcgtcacgaaccagtatcttatcaagggcatctcctacccagtatcgactacagtggttggccagtccctcatcatcacccagactgacagtcaaactaagtgcgagcttactagaaacatgcacacaacccactccatcaccgttgcattaaacatcagcctcgagaactgcgccttctgccagagcgctctgctggagtacgacgacacacagggcgtcatcaacatcatgtacatgcacgactccgacgacgtcctgttcgcgcttgatccctacaacgaggtcgtcgtgtccagtccacgaactcattacctcatgctgcttaagaacggcaccgtcctcgaggtcaccgacgtggtcgtcgatgctaccgactcccgcctcctcatgatgtccgtttacgcactctctgcgatcatcggcatctacttactatatcgcatgctcaagacctgc

SEQ ID NO: 179 - DNA, 834 bp, Artificial Sequence
  Synthetic polypeptide
atgtgcagaagaccagactgcggattcagcttctccccaggcccagtgatcttactttggtgctgcctcctccttccgattgtgagcagtgccgccgtgagcgtggctcctaccgcggccgagaaggtgccggccgagtgcccagagctcacccgaaggtgccttctgggcgaggttttcgagggagacaagtacgagtcttggctccggcctctggtcaacgtgacgggcagagacggccctttgagccagctcatcagatacagaccagtaacacctgaggccgccaattccgtcctgctggatgaggccttcctggacaccctcgccctcctttacaataacccagaccagctgagagccctgttgacccttctcagcagcgacaccgctccacggtggatgaccgtcatgagaggctatagcgagtgcggagatggcagccctgccgtctatacctgcgttgacgacctgtgcaggggctacgatttgacaaggctcagctacggcagatctatattcacagagcatgtgctgggcttcgagctggtgccgccatccctgttcaacgtggtggtcgctataaggaacgaggccaccagaacaaatcgcgccgtgagactgccggtgtccacggcagccgcacctgagggcattacactgttctatggcctctacaacgccgtgaaggagttctgtttgcggcaccagctggacccaccactgctcagacacctggataagtactacgctggcctgcctccggagctgaagcaaacacgtgtgaatctgccagcccactctcggtacggaccgcaggccgtggacgcccgg

SEQ ID NO: 180 - DNA, 834 bp, Artificial Sequence
  Synthetic polypeptide
atgtgcaggaggccagactgcggcttctcattcagcccaggcccagtcatcctcctttggtgttgcctccttctccctatagttagcagtgccgccgtgagcgtggcccctacagccgcggagaaggtgccagcggagtgcccggagttaaccagacgttgcctcttgggcgaggtgttcgagggcgataagtatgagtcctggctgcggcctctggtgaacgtgaccggcagagacggacctctgtcccagctgatcagatacagaccagtgacccctgaagccgcaaacagcgtgctgctggacgaggccttcctggacaccctggccctgttatacaacaaccctgaccagcttcgcgcgctgcttacactgctgagcagcgataccgccccaagatggatgactgtgatgaggggatatagcgagtgtggcgacggcagccctgccgtctacacctgtgtggacgacctctgcagaggctatgacctgaccagactgtcatacggccgaagcatcttcaccgagcacgtcttaggattcgagctggtgcctccaagcctcttcaatgtggtggtggccattcggaacgaggctaccagaaccaaccgggcggtgcgtcttccagtttctacagccgccgccccggaaggaattaccctgttctacggcctgtacaacgctgtcaaggagttctgcctgagacaccagctggatccaccgctgctgcgccacttggacaagtactatgcgggcctccctcctgagctcaagcagacgagggtgaacctccctgctcactcacgttatggaccacaggccgtggacgctaga

SEQ ID NO: 181 - DNA, 834 bp, Artificial Sequence
  Synthetic polypeptide
atgtgcagaaggccagactgcggcttcagcttctctccaggaccagtgatcctcctctggtgctgccttctcctccctattgtgtcctccgccgccgtgtccgtggccccaaccgccgccgagaaggtgccagcggagtgcccagagctcaccaggcgctgtctgctgggcgaggtgttcgagggcgataagtacgagagttggctgaggccgttggtgaacgtgacgggcagggacggcccgctaagtcagttaataaggtaccggccagtgaccccggaggccgccaacagcgtgctgctggatgaggccttcttggacaccctggccctgttgtacaacaacccagaccagctgagagccctgctgactctgttgagcagcgacaccgccccaagatggatgaccgtgatgagaggctatagcgagtgcggcgatggcagccctgccgtgtacacgtgcgtggacgatttgtgtagaggctacgacctcaccagactgagctacggcagaagcatcttcactgagcatgtgctgggattcgagctggtgcctcctagcctgttcaatgttgtggtggctatacgcaacgaggccacaagaacaaacagggccgtaagactcccagtgagcaccgctgcagcccctgagggaatcacgctgttctacggcctctacaacgctgtgaaggagttctgtctgaggcaccaactggacccacctctgcttagacacctggataagtactacgccggcctcccacctgaactgaagcagaccagggtgaatcttcctgcacactcaaggtatggcccacaggccgtggatgccagg

SEQ ID NO: 182 - DNA, 834 bp, Artificial Sequence
  Synthetic polypeptide
atgtgcaggcggccagactgcggcttcagcttctcaccgggcccagtcatcttgttgtggtgctgcctcctcctccctatcgtaagctcggcagccgtcagtgtggccccaaccgccgccgagaaggttccagccgagtgtccagaactcacaaggcggtgcctgctgggcgaggtcttcgagggcgacaagtatgaaagctggctcaggccacttgtcaatgtgacaggcagagacggcccactgagccagcttatccggtatagacctgtcactcctgaggccgctaacagcgtgcttctggacgaggctttcctggacactctggctctgctttacaacaacccagaccagctgagagccctgctgaccctgctgagcagcgatacagccccaaggtggatgacagttatgaggggatacagcgagtgtggcgacggaagcccagccgtgtatacctgcgtggatgacctgtgcagaggctacgacctgacccgcctctcctacggaagatccatcttcaccgagcacgtgctaggattcgagctcgtccctcctagcctgttcaatgtggtggtggccatcagaaacgaggccactcggaccaatagagcagtgagactgccagtgagcaccgcggccgcaccagagggtatcacactgttctacggcctgtacaacgccgtgaaggagttctgtctgcgtcaccagctggacccacctctgcttagacatctggataagtactatgccggcctgcctcctgaactcaagcagacccgtgtgaatctgcctgcccactccagatacggccctcaggccgtggacgcaagg

SEQ ID NO: 183 - DNA, 834 bp, Artificial Sequence
  Synthetic polypeptide
atgtgtagacgaccagactgcggcttctctttctctccaggcccggtgatcttactctggtgttgtttgctccttcctatcgttagtagcgccgccgtgagcgtggctccgacagccgccgagaaggtgccagccgagtgcccagagctcaccagaagatgtctgctgggcgaggtcttcgaaggcgacaagtacgagtcttggctgaggcctctcgtgaatgttaccggcagggacggcccactgagccagctgattaggtaccggccagtgaccccggaagccgccaacagcgtgctgctggatgaagccttcctggacaccctggccctgctgtacaacaatcctgaccagctccgggccctgctgaccctcctcagcagcgacactgcccctcggtggatgacagtcatgagaggctactccgaatgtggagacggcagccctgccgtctacacctgtgtggacgacctctgtaggggctacgacctgacaagactgtcctatggcagaagcattttcaccgagcatgtgcttggcttcgagctggtgcctccatccctgttcaacgtggttgtggccattagaaacgaggccaccagaaccaacagggccgtgcggctgccagtgagtacagccgctgctccagagggcattaccctgttctacggcctttacaatgccgtgaaggagttctgtctgcgccatcagctggaccctcctctgctgagacacctggataagtattacgcgggcctgcctccagaactgaagcagacccgcgtcaacctgccagctcatagccgttacggcccgcaagcagtggacgcccga

SEQ ID NO: 184 - DNA, 834 bp, Artificial Sequence
  Synthetic polypeptide
atgtgccgaagaccggactgcggcttcagcttcagcccaggcccggttatcctcctctggtgctgcctccttctcccaatcgtgagcagcgccgccgtgagcgtggcgcctaccgccgcggagaaggtcccagccgagtgcccagaattgacgaggagatgcttgctgggcgaagtgttcgagggcgataagtatgagagctggctgcggcctctggtcaacgtgaccggccgcgacggcccactgtcccagctgatcaggtacagaccagtgaccccagaggctgctaacagcgtgctgctggatgaggctttcctcgacacgctggctctcctgtacaacaatccggatcagctcagagccctgctcacactgctgtccagcgacaccgctccaaggtggatgacagtgatgcggggctactcagagtgcggcgacggtagccctgcggtgtatacatgtgtggacgacctgtgcagaggctacgacttaaccaggctgtcctacggtagatccatcttcactgagcacgtgctgggcttcgagctggtgccacctagcctgttcaatgtcgtggtagccatccggaacgaggctaccagaacaaatcgggccgtgaggctcccagtgagcaccgccgccgctcctgagggcatcactctgttctacggactttacaacgccgtcaaggagttctgcctgcggcaccagctcgatccacctctgctgagacacctggacaagtactacgccggccttccgcctgagctgaagcagaccagagtcaacctgcctgcccatagcagatacggcccacaggctgtggatgccaga

SEQ ID NO: 185 - DNA, 834 bp, Artificial Sequence
  Synthetic polypeptide
atgtgccggcggcccgactgcggcttcagcttcagccccggccccgtgatcctattgtggtgctgcctacttttgcccatcgtgagcagcgccgccgtgagcgtggctcctaccgccgccgagaaggtgcccgccgagtgccccgagctaacccggcggtgccttcttggcgaggtgttcgagggcgacaagtacgagagctggctgcggcccctggtgaacgtgaccggccgggacggccctctgagccagctgatccggtaccggcccgtgacaccagaggccgccaacagcgtgctgctggacgaggccttcctggacaccctggccctgctgtacaacaaccccgaccagctgagagctctgctgacgctgctgtcaagcgacaccgcgccacggtggatgaccgtgatgcggggctacagcgagtgcggcgacggcagccccgccgtgtacacctgcgtggacgacctgtgcaggggctatgacctgacccgtctgagctacggccggagcatcttcaccgagcacgtgctgggcttcgagctggtgcctcccagcctgttcaacgtggtggtggccatccggaacgaggccacccggaccaaccgggccgtgcggctgcccgtgagcaccgcagcagccccagaaggcatcaccctgttctacggcctgtacaatgccgtgaaggagttctgcctgcggcaccagctggacccacctcttctcaggcacctggataagtactacgccggcctgcctcctgaactgaagcagacccgggtgaacctgcccgcccacagccggtatggcccacaggccgtggacgcccgg

SEQ ID NO: 186 - DNA, 834 bp, Artificial Sequence
  Synthetic polypeptide
atgtgccggcggcccgactgcggcttcagcttcagccccggccccgtgatcctcctctggtgctgcctcttgttgcccatcgtgagcagcgccgccgtgagcgtggctcctaccgccgccgagaaggtgcccgccgagtgccccgagctcacccggcggtgccttctgggcgaggtgttcgagggcgacaagtacgagagctggctgcggcccctggtgaacgtgaccggccgggacggccctctgagccagctgatccggtaccggcccgtgactccagaggccgccaacagcgtgctgctggacgaggccttcctggacaccctggccctgctgtacaacaaccccgaccagctgagggcccttctgaccctgctcagcagcgacaccgccccacggtggatgaccgtgatgcggggctacagcgagtgcggcgacggcagccccgccgtgtacacctgcgtggacgacctgtgcaggggctacgacctgaccaggctgagctacggccggagcatcttcaccgagcacgtgctgggcttcgagctggtgccgcccagcctgttcaacgtggtggtggccatccggaacgaggccacccggaccaaccgggccgtgcggctgcccgtgtcgacagccgccgcccctgagggcatcaccctgttctacggcctatataacgccgtgaaggagttctgcctgcggcaccagctggacccgcccctgcttcgccacctggacaagtattacgccggcctgcctccggagctgaagcagacccgggtgaacctgcccgcccacagccggtacggccctcaggccgtggacgcccgg

SEQ ID NO: 187 - DNA, 834 bp, Artificial Sequence
  Synthetic polypeptide
atgtgccggcggcccgactgcggcttcagcttcagccccggccccgtgatcctcctttggtgctgcttgctcttgcccatcgtgagcagcgccgccgtctccgtcgctcctaccgccgccgagaaggtccccgccgagtgccccgagctcacccgccgctgcctcctcggcgaggtcttcgagggcgacaagtacgagtcctggctcagacctctcgtcaacgtcaccggccgcgacggcccactctcccagctcatccgctaccgccccgtcacaccggaggccgccaactccgtcctcctcgacgaggccttcctcgacaccctcgccctcctctacaacaaccccgaccagctccgagccctgctgaccctgctgtcctccgacaccgctcctcgctggatgaccgtcatgcgcggctactccgagtgcggcgacggctccccagctgtgtacacctgcgtcgacgacctctgcagaggctacgacctgacgcgcctctcctacggccgctccatcttcaccgagcacgtcctcggcttcgagctcgtgcctccctccctcttcaacgtcgtcgtcgccatccgcaacgaggccacccgcaccaaccgcgccgtccgcctccccgtcagcacagccgctgcaccagagggcatcaccctcttctacggactgtacaacgccgtcaaggagttctgcctccgccaccagctcgacccacctctgctgaggcatctggacaagtattacgccggcctcccaccagagctgaagcagacccgcgtcaacctccccgcccactcccgctacggaccacaggccgtcgacgcccgc

SEQ ID NO: 188 - DNA, 834 bp, Artificial Sequence
  Synthetic polypeptide
atgtgccggcggcccgactgcggcttcagcttcagccccggccccgtgatcctcctctggtgctgccttttgctccccatcgtgagcagcgccgccgtctccgtcgctcctaccgccgccgagaaggtccccgccgagtgccccgagctcacccgccgctgcctcctcggcgaggtcttcgagggcgacaagtacgagtcctggctcagacctctcgtcaacgtcaccggccgcgacggcccactctcccagctcatccgctaccgccccgtcaccccagaggccgccaactccgtcctcctcgacgaggccttcctcgacaccctcgccctcctctacaacaaccccgaccagctcagggcccttctaaccctgctgtcctccgacaccgcccctcgctggatgaccgtcatgcgcggctactccgagtgcggcgacggctccccggccgtgtacacctgcgtcgacgacctctgcagaggatacgacctcacccggctctcctacggccgctccatcttcaccgagcacgtcctcggcttcgagctcgtcccaccctccctcttcaacgtcgtcgtcgccatccgcaacgaggccacccgcaccaaccgcgccgtccgcctccccgtcagcacagccgcagccccagagggcatcaccctcttctacggcctgtataacgccgtcaaggagttctgcctccgccaccagctcgacccgcctctgctgaggcacctggacaagtattacgccggcctccctcctgagctgaagcagacccgcgtcaacctccccgcccactcccgctatggaccacaggccgtcgacgcccgc

SEQ ID NO: 189 - DNA, 2094 bp, Artificial Sequence
  Synthetic polypeptide
atggagagcagaatttggtgcttggtggtgtgtgttaacctctgcattgtttgcctcggcgcagcagtgtctagcagctctactcggggaacatccgcaacccacagccaccatagctcacacaccaccagcgccgcccactccagatccggtagcgtgagccagcgggtgactagcagccagactgtgtcccatggcgtcaacgagacaatctacaacaccaccctgaagtacggcgacgtcgtgggcgtgaacacaacgaagtacccttacagggtgtgtagcatggctcagggcaccgacttgatccggttcgagagaaatattgtatgcaccagcatgaagccaattaacgaggatctggacgaaggcatcatggtagtgtataagagaaacatagttgcacacactttcaaggtgagggtctaccagaaggtgctgaccttccgccgaagctatgcttacatccatactacctacctgctcggttctaacaccgagtatgtggcacctccaatgtgggagatccaccacatcaattctcatagccagtgttacagctcttacagccgggtgatagccggcaccgtcttcgtggcctaccatagagattcatacgagaacaagaccatgcagctgatgccagacgactacagcaacacccattccaccaggtatgtgacagtcaaggaccaatggcactcacgcggctccacctggctgtacagggagacttgcaacctcaattgcatggtgaccatcaccaccgcccgcagcaagtacccgtaccacttcttcgccaccagcaccggagatgtcgtggacatcagccctttctataacggcactaacagaaacgccagttacttcggagagaatgccgacaagttcttcatcttcccgaactacactattgtgagcgatttcggtcgccctaactccgccctggagacacaccgcctggttgccttcctggagagagccgattccgtgatcagctgggacatccaggacgagaagaatgtgacctgtcagctcactttctgggaggcctccgagaggactatccggagcgaggccgaggactcataccatttcagcagcgccaagatgaccgccaccttcctgtcaaagaagcaggaggtgaacatgtcagatagcgctctggactgtgtgcgcgacgaggctattaacaagctgcagcagatcttcaatacctcctacaatcagacctacgagaagtatggtaacgtgtcagtattcgagacaactggcggcctcgtggtgttctggcagggaatcaagcagaagtccctggtggagcttgaaagactcgccaaccggagcagcctgaacctgacccacaacaggacaaagagatctacagatggtaacaacgccacccatctgagcaacatggagtccgtgcacaacctggtgtacgcccagctccagttcacatacgacaccctgagaggctacattaatagagccctcgcccaaatcgcagaggcctggtgcgtggaccagaggcgaaccctggaggtgttcaaggaattgagcaagatcaatccaagcgccatcttgagcgcaatctataacaagccgattgcggccagattcatgggcgacgtgttgggcctggcctcctgcgtcactatcaaccagacctctgtcaaggtgctcagagatatgaacgttaaggagtccccaggcagatgctatagcagacctgtcgtgattttcaatttcgccaactcaagctacgtgcagtacggccagctcggcgaagataacgagatcctgctgggcaaccacagaaccgaagagtgccagctgccttccctgaagattttcatcgctggcaactccgcttacgagtacgtggattacctgttcaagagaatgatcgacctcagcagcatcagcaccgtggacagcatgatcgccttagacattgaccctctggagaacacagatttcagggtgctggaactatactctcagaaggagctccggtctagcaacgtgttcgatctggaggagatcatgcgggagttcaattcctacaagcagcaccaccaccatcatcac

SEQ ID NO: 190 - DNA, 2094 bp, Artificial Sequence
  Synthetic polypeptide
atggagtcaagaatctggtgtcttgtggtgtgcgtgaacttgtgtatcgtgtgtttgggcgcagccgtgtcctcaagcagcactagaggcactagcgccacccactcccatcatagctcacacaccacaagcgccgcccactctaggtcaggcagcgtgtctcagcgcgtgacctctagccagactgtgagtcacggagtcaatgaaaccatctacaacacaacactgaagtacggagacgtcgtgggcgtgaatacaaccaagtacccatacagggtgtgcagcatggctcagggcactgacctcatcagattcgagcggaacattgtgtgcacctcaatgaagcctatcaacgaggatttggatgaaggcatcatggtcgtgtacaagagaaacatcgtcgctcataccttcaaggtgagagtgtatcagaaggtgctgaccttcagacgtagctacgcttacattcacaccacctacctgctgggcagcaacaccgagtatgtggctcctcctatgtgggagatacatcacatcaacagccattctcagtgctatagttcttatagcagggtcatcgccggcaccgtcttcgtggcctaccatagagatagctacgagaacaagaccatgcagttgatgccggacgattacagcaatacccatagcactaggtacgtgactgtgaaggaccagtggcactcccggggtagcacctggctttacagggaaacctgcaatctgaactgcatggtgactattaccaccgccaggagcaagtatccttaccacttcttcgctacatctactggagacgtggtcgatatctctcctttctacaatggcacaaacagaaatgcttcatatttcggcgagaatgccgacaagttcttcatcttcccaaactacaccattgtgtccgacttcggaagacctaattccgccctggaaacccatagactggtcgcattcctggaaagggccgactccgtcatttcatgggacatccaggatgagaagaacgtcacctgtcagctcacattctgggaagcgagcgaaagaacaattcgcagcgaagccgaggacagctatcatttcagcagtgctaagatgaccgccactttcctgtctaagaagcaggaggtgaacatgtccgacagcgccttggattgcgtgagagacgaagctattaacaagctgcagcagatcttcaacacctcctacaaccagacttacgagaagtatggcaatgtgagtgtgttcgagacaaccggcggcctggtagtattctggcagggcatcaagcagaagtcactggtggagcttgagaggctggccaatagatccagcctgaacctgacccacaaccggacaaagagatctaccgacggaaacaacgccactcatctttccaatatggagagcgtgcacaacctggtgtacgcgcagctccagttcacctacgacacactgaggggctacataaacagggccctggcacagatcgccgaagcctggtgcgtggaccagagaaggaccctggaggttttcaaggagctgagcaagattaatccgtccgctatcctgagcgcaatatacaataagccaatcgccgccagattcatgggcgacgtgttgggactggccagttgcgtcacaataaaccagacctctgtaaaggtcctgagggacatgaatgtcaaggagagcccgggcaggtgctacagccgtcctgtggtgattttcaacttcgctaattcatcttacgtccagtacggccagctgggcgaagacaatgagatcttactgggcaaccataggactgaggagtgccagctgccgagtctgaagattttcatagccggcaatagcgcatatgaatatgtagactacctgttcaagaggatgattgacctctctagcatctcgaccgtggacagcatgatcgccctcgacatcgaccctctggagaacacagacttccgggtcctcgaactgtacagccagaaggagcttaggagctccaacgtgttcgatcttgaggagatcatgagggagttcaatagctataagcaacatcaccaccatcatcac

SEQ ID NO: 191 - DNA, 2094 bp, Artificial Sequence
  Synthetic polypeptide
atggagagcagaatttggtgtctcgtggtgtgtgttaatctctgcatcgtgtgccttggcgccgccgtgtccagcagctccaccaggggcaccagcgcaacacacagccaccactctagccacacaaccagcgccgcccactctcgttcaggctccgtttcacagagggtgacctcctctcaaaccgtgtctcatggagtgaatgaaaccatttataacacaacactgaagtatggcgacgtggtgggcgtcaacaccaccaagtatccttaccgggtttgttcaatggcccagggcaccgatctcatcagattcgagcgaaatatcgtgtgtacatccatgaagcctatcaacgaagacctggacgagggaattatggtcgtgtacaagagaaatattgtggcccacactttcaaggtgagagtgtaccagaaggtgttgacattcaggcggtcctacgcctacatccacaccacttatctgttgggatccaacacagagtacgtcgcaccgcctatgtgggaaatacatcacatcaattcccattctcagtgctattctagctactccagagtgatcgccggcaccgtgttcgtggcctaccaccgcgatagctacgagaataagaccatgcagctgatgcctgacgattacagcaacactcattccacacgctacgtgaccgtgaaggatcagtggcacagccgcggcagcacctggctgtaccgggaaacctgcaacctgaactgcatggtgacaataacaaccgcacgtagcaagtacccataccacttcttcgccacctccaccggtgacgtggtcgacatcagccctttctacaatggcaccaacagaaatgcctcctacttcggcgagaacgccgacaagttcttcatcttccctaattatacaattgtgagcgacttcggcaggcctaacagcgccctggagactcatcgcttggtggctttcctggaacgcgctgacagcgtcatctcttgggatatccaagatgagaagaacgtgacctgccagctgaccttctgggaggccagcgagaggacaatcagaagcgaagccgaggactcttaccatttcagttcagctaagatgaccgccaccttcctgagcaagaagcaggaagtgaatatgtccgattccgctcttgactgcgtcagggacgaagccatcaacaagctccagcagattttcaatacttcttataatcagacctatgagaagtacggcaatgtcagcgtcttcgagacgaccggcggcctggttgtgttctggcaaggaatcaagcagaagtcactggtggagcttgagcggctggccaacagatccagcttgaacctgacccataatcgcaccaagcggagtaccgatggcaacaacgccacacacctcagcaatatggaaagcgtgcacaaccttgtgtacgctcagctgcagttcacctacgatacccttagaggctacatcaacagagccctggcccagatcgcagaggcatggtgcgtggaccagcggcggaccctggaggtgttcaaggagctctccaagatcaacccatccgccattctctccgccatctacaacaagcctattgccgctcggttcatgggcgatgtgctgggactggccagctgcgtgaccatcaaccaaacctcagtgaaggtgctcagagacatgaacgtcaaggagtctccaggcagatgttacagcagacctgtggtgatcttcaacttcgccaattcttcctacgtgcagtacggccaactgggtgaagacaacgagattctgttaggcaaccacaggactgaggagtgtcagctgccgagcctgaagatcttcatcgctggaaacagcgcatacgagtacgtggactacctcttcaagaggatgatcgacttgtcatctatctccacggttgattccatgatcgccttggacatcgatcctctggagaataccgacttcagagtgctggagctctacagccagaaggagcttaggtctagcaatgtgttcgacctggaggagatcatgagggagttcaatagctataagcagcatcaccaccaccatcac

SEQ ID NO: 192 - DNA, 2094 bp, Artificial Sequence
  Synthetic polypeptide
atggagagcagaatctggtgcctcgtggtgtgcgtgaacctctgtatcgtctgcttaggagccgccgtgagcagtagctctaccagaggcacatccgccacccacagccaccactcttcacacaccaccagcgccgcccactccagatcaggcagcgtatcccagagagtgaccagcagccagaccgtgtcacatggagtgaatgaaacaatttacaacaccaccctcaagtacggcgacgtagtgggagtgaacactactaagtacccataccgcgtgtgtagcatggcccagggcaccgatctgatccgattcgagagaaacatcgtttgcaccagcatgaagcctatcaacgaggacctggatgagggcatcatggtggtgtacaagaggaacatcgtggcccacacgttcaaggttagggtgtaccagaaggtgctgactttccgaagaagctatgcctacattcacactacatacctgctcggcagtaacaccgagtacgtggcgccaccgatgtgggaaatacaccatattaattctcatagtcagtgctattccagctacagcagggtgatcgccggaaccgttttcgtggcttatcatagagattcctacgagaacaagaccatgcagctgatgccagacgactatagcaacacgcatagcacccgctacgtgaccgtgaaggaccagtggcattcaagaggatccacctggctctacagagagacatgcaatctgaactgcatggtgaccatcaccaccgcccggtccaagtacccttatcacttcttcgccacaagcaccggcgatgtggtggacatttccccattctacaacggaaccaaccggaacgcctcttacttcggcgagaacgccgacaagttcttcatcttcccaaattataccatcgtgagcgacttcggaagacctaacagcgccctggagacacacagactggtggccttcctcgagcgcgccgactccgtgatctcctgggacatccaggacgagaagaacgtgacttgtcagctgacattctgggaggccagcgaacggaccatcagaagcgaggctgaagactcctaccacttcagctccgccaagatgaccgccactttcctgtcaaagaagcaggaggtgaacatgagcgacagcgccttggattgcgtgagagatgaggccatcaacaagcttcaacagatcttcaacacatcctacaaccagacgtacgagaagtacggaaacgtgagcgtgttcgaaaccaccggcggcttagtggtgttctggcagggaatcaagcagaagtctctggtggagctggagagactggctaacagatcctctctaaacctgacacacaacagaaccaagcggagcacagacggcaataatgccacacacctgagcaacatggaaagcgtccacaacctcgtctatgcccaactgcagttcacctacgacaccctccgaggctacatcaacagagccctggcccagatcgccgaggcttggtgtgtggatcagagacggaccctggaggtgttcaaggagttgagcaagatcaacccgtccgccatcttgagcgctatatacaacaagccaattgctgcgcggttcatgggcgacgtgctgggcctcgcctcatgtgtgaccattaatcaaacaagcgtcaaggtcctgagggatatgaacgttaaggagagcccaggcaggtgctatagcagacctgtggtgattttcaacttcgccaacagcagctacgtgcagtacggccagctgggcgaggacaacgagatcctgctgggcaaccaccgcactgaggagtgccagctgccaagtctgaagatattcatcgcgggaaattcagcttacgagtatgtagactacctgttcaagagaatgatagatcttagcagcatctccactgtggacagtatgatagctcttgatattgacccactggagaataccgacttcagagtgttggagctgtacagtcagaaggagctcaggagctccaatgtgttcgacctggaggagatcatgagggaattcaatagctacaagcagcaccaccaccatcatcac

SEQ ID NO: 193 - DNA, 2094 bp, Artificial Sequence
  Synthetic polypeptide
atggaatcccgaatctggtgcctcgttgtgtgcgtgaatttgtgcatcgtgtgtttgggcgccgccgtctcttcttcctccacacgtggtaccagcgcaacacactcccaccactcaagccacaccacgtccgcggcacacagcagaagcggcagtgtgagccaaagggtgaccagcagccagaccgtgagtcacggcgtgaacgagacaatctacaataccacactcaagtacggcgatgtggtgggcgtcaacaccaccaagtatccttacagagtctgttccatggcccagggcactgacctgatccggttcgaaagaaacatagtgtgcacctccatgaagcctatcaatgaggacctcgatgaaggcattatggtggtgtacaagaggaatattgtggcccataccttcaaggtgagagtgtaccagaaggtgctgaccttcagacggagctacgcctacatccatacaacctacctgctgggaagcaacaccgagtacgtggctcctccaatgtgggagatccaccacatcaatagccacagccagtgctactccagctacagcagagtgattgctggcaccgtcttcgtggcttaccacagagacagctatgagaacaagacaatgcagctcatgccagacgactactctaacacacattcaacccggtatgtgaccgtgaaggaccagtggcactcaagaggcagcacatggctctaccgagagacatgtaacctgaactgcatggttacaatcaccactgcaaggtctaagtacccatatcacttcttcgccacctctaccggagacgtggtggacatcagcccattctacaatggcaccaatcggaacgcaagctacttcggagagaacgccgacaagttcttcatcttcccgaactacaccatcgtgtccgatttcggcaggccaaacagcgccctggagacacaccggctggtggccttcctggagcgcgctgactccgttatctcttgggacatccaggatgagaagaatgtgacctgccaactgacattctgggaggcatccgagcggactatcagaagcgaggccgaggacagctaccacttcagcagcgctaagatgactgctaccttcctgtccaagaagcaggaggtgaacatgtctgattccgctctggactgcgtgagggacgaggctatcaacaagctccagcagatattcaatacttcctacaaccagacctacgagaagtacggtaacgtcagcgttttcgaaaccaccggcggcctggtcgtgttctggcagggaatcaagcagaagtcccttgtcgagctcgagagactggccaaccggtctagcctcaatctgacacacaataggaccaagagatctactgacggcaataacgccacacacctctccaacatggagagtgttcataacctggtttacgcccagctgcagttcacttacgataccctccgcggctacatcaacagggccctggcgcagatcgccgaggcctggtgcgtggatcaaagaaggaccctggaggtcttcaaggaactcagcaagatcaacccatctgctatcctgagcgccatctacaacaagccaatcgccgcccggttcatgggcgacgtcctgggcttggctagctgcgtgaccatcaatcagaccagcgtcaaggtgcttcgcgacatgaacgtcaaggagtcacctggccgctgttactcaaggccagtcgtgatcttcaatttcgccaatagctcctacgtgcagtacggacagttgggcgaggacaatgaaatactcctgggcaaccaccgcaccgaggagtgtcagctgccaagcctgaagatcttcatcgcgggaaactccgcttacgagtatgtggactacctgttcaagagaatgattgatctgagcagcatctccaccgtggacagcatgattgctctggatattgatcctctggagaacaccgatttccgcgtgctggagctgtacagccagaaggaattaaggagcagtaatgtgttcgacctggaggagatcatgagggagttcaacagttacaagcagcaccaccatcaccaccac

SEQ ID NO: 194 - DNA, 2094 bp, Artificial Sequence
  Synthetic polypeptide
atggagtccagaatctggtgcttggtggtgtgcgtgaatctttgcattgtgtgcctcggcgccgccgtgagcagcagcagtactagaggtacctccgctacccacagccaccactcttcccatacaaccagcgccgcccactcacgtagcggctctgtgagccagagggtgacaagctcacagaccgtgagccacggcgtgaacgagactatctacaacactaccctgaagtacggcgatgtggtgggagtgaataccacaaagtacccgtacagggtgtgttccatggcccagggcaccgacctgattcgcttcgaaagaaacatcgtctgcaccagcatgaagcctatcaacgaggatttggatgagggtattatggtggtctacaagagaaatattgtggcccacaccttcaaggtcagagtgtaccagaaggtcctgacgttcaggagatcttacgcttacatccacaccacctaccttctgggctccaacaccgagtatgtggccccgcctatgtgggagatccaccacattaattcccactctcaatgctacagctcctattccagagtgatcgccggcacagtcttcgtggcctaccaccgggacagctatgagaacaagactatgcagctcatgccagacgactatagcaatactcatagcactagatatgtgactgtgaaggaccagtggcatagcagaggcagcacttggctgtaccgggaaacatgcaatcttaattgcatggtcaccataaccaccgcgagatccaagtacccttaccacttcttcgccacctccactggtgacgtcgtggacatctcccctttctataacggaacaaatagaaacgccagctacttcggtgagaacgccgacaagttcttcatcttccctaactacaccatagtgagcgatttcggcagaccgaactccgctctggagacacaccggctggtggccttcctggaacgggccgatagtgttatctcttgggatattcaagacgagaagaacgtcacctgtcagctgactttctgggaagccagcgagaggaccatcagaagtgaagctgaggatagctaccatttctctagtgccaagatgactgccaccttcctgtccaagaagcaggaggtcaacatgtccgacagcgccctcgactgtgtgagagacgaggctattaacaagctgcagcagattttcaacactagctacaatcagacatacgagaagtatggaaacgtgagcgtgttcgaaactaccggtggcctggtggtattctggcagggcatcaagcagaagtccctggtggaattggagagactggctaacaggtcgtccctgaacctgactcacaatagaacgaagaggagcacagacggcaataatgccacccatctgtccaatatggagagtgtgcacaatttggtgtatgcccagctgcagttcacctacgacaccctcaggggctacatcaacagagccctcgcccagatcgctgaagcctggtgcgtggatcagaggaggaccctggaggtcttcaaggaactgagcaagataaacccatccgccatcctcagtgccatttataacaagcctattgccgccaggttcatgggcgacgtgctgggcctggcttcctgtgtcacgattaatcagacctccgtgaaggtgctgagggacatgaacgtgaaggaaagccctggacggtgttacagccgaccagtagtgatcttcaacttcgccaactcctcatacgtgcagtatggccagctgggcgaggacaatgaaattctgctgggcaaccacaggaccgaagagtgccagctgcctagcctgaagatattcatcgccggtaatagcgcctacgagtacgtcgactatcttttcaagagaatgatcgatctgtctagcatttctaccgtggattccatgatcgctcttgacattgacccactggagaacacagacttcagggtgctcgagctgtattcccagaaggaactcaggtctagcaacgttttcgacctcgaggaaattatgagagagttcaactcgtacaagcaacaccatcaccaccatcac

SEQ ID NO: 195 - DNA, 2094 bp, Artificial Sequence
  Synthetic polypeptide
atggagagccggatctggtgcctcgtggtgtgcgtgaacttatgcatcgtgtgcctcggcgccgccgtgagctctagctctacccggggcaccagcgccacccacagccaccacagcagccacaccacctcggccgctcacagccggagcggcagcgtgagccagcgggtgacctccagccagaccgtgtcccacggcgtgaacgagacgatctacaacaccaccctgaagtacggcgacgtggtgggagtgaacacgaccaagtacccctaccgggtgtgcagcatggcccagggcaccgacctgatccggttcgagcggaacattgtgtgcaccagcatgaagcccatcaacgaggacctggacgagggcatcatggtagtgtacaagagaaacatcgtggcccacaccttcaaggtgcgggtgtaccagaaggtgctgaccttccggcggagctacgcctacattcacacaacatacctgctgggcagcaacaccgagtacgtggctcctcccatgtgggagatccaccacatcaactctcatagccagtgctacagcagctacagccgggtgatcgccggcaccgtgttcgtggcctaccaccgggacagctacgagaacaagaccatgcagctgatgcccgacgactatagcaacacacactccactcggtacgtgaccgtgaaggaccagtggcacagcagaggcagcacctggctgtaccgggagacttgcaacctgaactgcatggtgaccatcaccaccgcccggtctaagtacccttaccacttcttcgccaccagcaccggcgatgtggtggacatcagccccttctacaacggcaccaaccggaacgccagctacttcggcgagaacgccgacaagttcttcatcttccccaactacaccatcgtgagcgacttcggccggcccaacagcgccctggaaactcaccggctggtggccttcctggagcgggccgacagcgtgatcagctgggacatccaggacgagaagaacgtgacctgccagctgacattctgggaggccagcgagcggaccatccggagcgaggccgaggatagctatcacttcagcagcgccaagatgaccgccaccttcctgagcaagaagcaggaggtgaacatgagcgattctgcactggactgcgtgcgggacgaggccatcaacaagctgcagcagatcttcaacaccagctacaaccagacctacgagaagtacggaaacgtgagcgtgttcgagactaccggcggccttgtcgtgttctggcagggaatcaagcagaagtccctggtcgagctcgagcgactggccaacagaagcagcctgaacctgacccacaaccggaccaagcggagcaccgacggcaacaacgccacacacctgtctaacatggagtctgtgcacaacctggtgtacgcccagctgcagttcacctacgacaccctgcggggctacatcaaccgggccctggcccagatcgccgaggcatggtgcgtggaccagcggcggaccctggaggtgttcaaggagctctctaagatcaacccgtctgccatcctgagcgccatttacaacaagcctatcgccgcaagattcatgggcgacgtcctgggcctggccagctgcgtgacgatcaatcagaccagcgtgaaggtcctgcgggacatgaacgtcaaggagagccccggcaggtgctatagccggcccgtggtgattttcaacttcgccaatagctcttacgtgcagtacggtcagttaggcgaggacaacgagatcttactgggcaaccaccggaccgaggagtgccaactcccgagcctcaagattttcattgccggcaatagcgcatacgaatatgtggactacctgttcaagcggatgatcgacctgagcagcatcagcaccgtggacagcatgattgctctggacatcgaccctctggagaacaccgacttccgggtgctggagctgtacagccagaaggagctgcggagctctaatgtgttcgacctggaggagatcatgcgggagttcaactcatataagcagcaccaccaccatcatcac

SEQ ID NO: 196 - DNA, 2094 bp, Artificial Sequence
  Synthetic polypeptide
atggagagccggatctggtgcctcgtggtgtgcgtgaacctttgcatcgtgtgcttgggcgccgccgtgagcagcagctccacccggggcacctccgccacccactcccaccactcctcccacaccacctcagccgcccactctcgctccggctccgtctcccagcgcgtcacctccagccagaccgttagccacggcgtcaacgaaaccatctacaacaccaccctcaagtacggcgacgtcgtcggcgtaaacacaaccaagtacccctaccgcgtctgctccatggcccagggcaccgacctcatccgcttcgagcgcaacatcgtctgcacctccatgaagcccatcaacgaggacctcgacgagggcatcatggtcgtctacaagcgcaatattgtggcccacaccttcaaggtccgcgtctaccagaaggtcctcaccttccgccgctcctacgcctacatccacacaacctacctcctcggctccaacaccgagtacgtcgcccctcccatgtgggagatccaccacatcaacagccacagccagtgctactcctcctactcccgcgtcatcgccggcaccgtcttcgtcgcctaccaccgcgactcctacgagaacaagaccatgcagctcatgcccgacgactacagcaatacccacagcacccgctacgtcaccgtcaaggaccagtggcacagcagaggctccacctggctctaccgcgagacatgcaacctcaactgcatggtcaccatcaccaccgcccgctccaagtatccttaccacttcttcgccacctccaccggcgatgtcgtggacatctcaccattctacaacggcaccaaccgcaacgccagttacttcggcgagaacgccgacaagttcttcatcttccccaactacaccatcgtctccgacttcggccgccccaactccgccctcgagacacacagactggtggccttcctcgagcgcgccgactccgtcatctcctgggacatccaggacgagaagaacgtcacctgccagctcacattctgggaggcctccgagcgcaccatccgctccgaggccgaggactcataccatttctccagcgccaagatgaccgccaccttcctctccaagaagcaggaggtcaacatgagcgacagcgctctcgactgcgtccgcgacgaggccatcaacaagctccagcagatcttcaacacctcctacaaccagacgtacgagaagtatggaaacgtcagtgtcttcgaaaccacgggcggcctggttgtattctggcagggaataaagcagaagtccctcgtcgagcttgagcgcctcgccaaccgctcctccctcaacctcacccacaaccgcaccaagcgctccaccgacggcaacaacgctacccacctgtccaacatggagtccgtccacaacctcgtctacgcccagctccagttcacctacgacaccctccgcggctacatcaaccgcgccctcgcccagatcgccgaggcctggtgcgtcgaccagcgccgcaccctcgaggtcttcaaggagctgagtaagatcaaccctagcgcgatcctcagcgctatctataacaagccaatcgctgctaggttcatgggagacgtgctcggcctcgcctcctgcgtgaccatcaatcagacatccgtgaaggtgctgcgcgacatgaatgtcaaggagagcccaggccgctgttattcccggcccgtcgtcattttcaatttcgccaatagctcttacgtccagtacggccagctcggcgaggacaacgagatcctgctgggcaaccaccgcaccgaggagtgccagctgcctagcctcaagattttcattgccggcaattccgcttacgaatacgtggactacctcttcaagcgcatgatcgacctctcctccatctccaccgtcgactccatgatcgccctggatatcgaccctctcgagaacaccgacttccgcgtgttggagctctactcccagaaggagctcagatccagcaacgtattcgacctcgaggagatcatgcgcgagttcaactcctataagcagcaccaccaccatcatcac

SEQ ID NO: 197 - DNA, 2094 bp, Artificial Sequence
  Synthetic polypeptide
atggagagccggatctggtgcttggtggtgtgcgtgaacttgtgcatcgtgtgcttgggcgccgccgtgagcagctctagcacccggggcaccagcgccacccacagccaccacagcagccacacgacctccgccgcccactcacggagcggcagcgtgagccagcgggtgaccagctcacagaccgtgtcccacggcgtgaacgagacgatctacaacaccaccctgaagtacggcgacgtggtgggcgtcaacactaccaagtacccctaccgggtgtgcagcatggcccagggcaccgacctgatccggttcgagcggaatattgtgtgtaccagcatgaagcccatcaacgaggacctggacgagggcatcatggtggtctacaagagaaacattgtggcccacaccttcaaggtgcgggtgtaccagaaggtgctgaccttccggcggagctacgcctacatccatacaacctacctgctgggcagcaacaccgagtacgtggcgcctcccatgtgggagatccaccacatcaactctcactcgcagtgctacagcagctacagccgggtgatcgccggcaccgtgttcgtggcctaccaccgggacagctacgagaacaagaccatgcagctgatgcccgacgactattctaacacccactccaccagatacgtgaccgtgaaggaccagtggcacagcaggggcagcacctggctgtaccgggagacttgcaacctgaactgcatggtgaccatcaccaccgcccggagtaagtatccatatcacttcttcgccaccagcacgggcgacgttgtggacatcagccccttctacaacggcaccaaccggaacgccagctacttcggcgagaacgccgacaagttcttcatcttccccaactacaccatcgtgagcgacttcggccggcccaacagcgccctggaaacccaccggctggtggccttcctggagcgggccgacagcgtgatcagctgggacatccaggacgagaagaacgtgacctgccagctgactttctgggaggccagcgagcggaccatccggagcgaggccgaagactcctaccacttcagcagcgccaagatgaccgccaccttcctgagcaagaagcaggaggtgaacatgagcgattcagctctggactgcgtgcgggacgaggccatcaacaagctgcagcagatcttcaacaccagctacaaccagacttacgagaagtatggaaacgtgagcgtgttcgagacaaccggcggcctcgtggtgttctggcagggtatcaagcagaagtctctcgtggagctggagagactggccaacagaagcagcctgaacctgacccacaaccggaccaagcggagcaccgacggcaacaacgctacccatctgtctaacatggagtcagtgcacaacctggtgtacgcccagctgcagttcacctacgacaccctgcggggctacatcaaccgggccctggcccagatcgccgaggcctggtgcgtggaccagcggcggaccctggaggtgttcaaggagctgtccaagatcaacccttccgccatcctgagcgccatttataataagccgatcgccgcccggttcatgggcgatgttctgggcctggccagctgcgtcaccattaatcagaccagcgttaaggtcctgcgggacatgaatgtcaaggagagccccggcaggtgctactcccgccccgtggtgatattcaacttcgccaactctagctacgtgcagtacggccaactaggcgaggacaacgagatcttgctcggtaaccaccggaccgaggagtgccagttaccttccctgaagattttcatcgcgggcaactccgcctacgagtatgtggactacctgttcaagcggatgatcgatctttctagcatcagcaccgtggacagcatgatagccctggacatcgacccactggagaacaccgacttccgggtgctggagctgtacagccagaaggagcttcggagcagcaatgtgttcgacctggaggagatcatgcgggagttcaattcttacaagcagcaccaccaccatcatcac

SEQ ID NO: 198 - DNA, 2094 bp, Artificial Sequence
  Synthetic polypeptide
atggagagccggatctggtgcctcgtggtgtgcgtgaacctctgcatcgtgtgcctcggcgccgccgtgtcttcatcctccacccggggcacctccgccacccactcccaccactcctcccacaccactagtgccgcccactcacgctccggctccgtctcccagcgcgtcacctcatcccagacagtgagccacggcgtcaacgaaaccatctacaacaccaccctcaagtacggcgacgtcgtgggcgtgaacactacaaagtacccctaccgcgtctgctccatggcccagggcaccgacctgatccgcttcgagcgcaacatcgtctgcacctccatgaagcccatcaacgaggacctcgacgagggcatcatggtcgtctacaagaggaacattgtggcccacaccttcaaggtccgcgtctaccagaaggtcctcaccttccgccgctcctacgcctacatccacactacgtacctcctcggctccaacaccgagtacgtcgcccctcccatgtgggagatccaccacatcaactcgcacagccagtgctactcctcctactcccgcgtcatcgccggcaccgtcttcgtcgcctaccaccgcgactcctacgagaacaagaccatgcagctcatgcccgacgactatagcaacacacatagcacccgctacgtcaccgtcaaggaccagtggcatagcagaggctccacctggctctaccgcgagacgtgcaacctcaactgcatggtcaccatcaccaccgcccgcagcaagtatccatatcacttcttcgccacctccacaggagacgtggtcgacatctcgcctttctacaacggcaccaaccgcaacgctagctacttcggcgagaacgccgacaagttcttcatcttccccaactacaccatcgtctccgacttcggccgccccaactccgccctcgagactcaccgcttggtggccttcctcgagcgcgccgactccgtcatctcctgggacatccaggacgagaagaacgtcacctgccagctgaccttctgggaggcctccgagcgcaccatccgctccgaggccgaggacagctaccacttcagcagcgccaagatgaccgccaccttcctctccaagaagcaggaggtcaacatgagcgacagcgcccttgactgcgtccgcgacgaggccatcaacaagctccagcagatcttcaacacctcctacaaccagacttatgagaagtacggaaacgtctccgttttcgagacaacaggaggcctggttgtcttctggcagggcattaagcagaagtccctcgtcgagctggagagactcgccaaccgctcctccctcaacctcacccacaaccgcaccaagcgctccaccgacggcaacaatgctacacacctgagcaacatggagtccgtccacaacctcgtctacgcccagctccagttcacctacgacaccctccgcggctacatcaaccgcgccctcgcccagatcgccgaggcgtggtgcgtcgaccagcgccgcaccctcgaggtcttcaaggagctgtccaagatcaaccctagcgccatcctgtccgcaatctataacaagcctatcgcggctaggttcatgggcgatgtgctcggcctcgcctcctgcgtgactattaatcagaccagcgtcaaggtgctgcgcgacatgaacgtgaaggagagccctggccgctgctattccaggcccgtcgtcatcttcaatttcgccaattccagctatgtccagtacggccagctcggcgaggacaacgagatcctgcttggcaaccaccgcaccgaggagtgtcagctccctagcctgaagattttcattgccggcaatagcgcttatgagtatgtggactacctcttcaagcgcatgatcgacctctcctccatctccaccgtcgactccatgatcgccctggacatcgacccactggagaacaccgacttccgcgtgctcgaactctactcccagaaggaactgagatcaagcaacgtgttcgacctcgaggagatcatgcgcgagttcaactcttataagcagcaccaccaccatcatcac

SEQ ID NO: 199 - DNA, 642 bp, Artificial Sequence
  Synthetic polypeptide
atgctcagacttctcctcagacaccacttccactgcctcttgctttgtgccgtctgggccacaccttgcctcgccagcccttggagcaccttgacagccaaccagaacccttcccctccttggtcaaagttgacctacagcaagcctcacgacgctgctaccttctactgtccattcctgtaccctagccctccaagatctccgctgcagttcagcggcttccagagggtgtctaccggacctgagtgcaggaatgagacgctgtacctgctgtacaacagagagggccagaccctggtggaaagaagctccacctgggtcaagaaggtaatctggtacctgagcggcagaaaccagacaatactccagagaatgccacggaccgctagcaagcctagcgatggaaacgtgcagattagcgtggaggacgcaaagattttcggcgcccacatggtgccaaagcagacaaagctgctgcggttcgtggtcaacgacggcacccggtaccagatgtgcgtgatgaagctggagagctgggctcacgtgttcagagattactctgtgagcttccaagtgcggctcaccttcaccgaagccaacaatcagacctacactttctgtactcaccctaacctgatcgtg

SEQ ID NO: 200 - DNA, 642 bp, Artificial Sequence
  Synthetic polypeptide
atgcttagactcctcctcagacaccacttccattgtctccttttgtgcgccgtgtgggccaccccttgccttgcatcaccttggtctaccctcaccgccaaccagaaccctagccctccttggagtaagttaacatactctaagccgcacgacgccgccaccttctactgtcctttcctctacccaagcccacctcgtagcccacttcagttctctggattccagagagtttcaacaggccctgagtgtcggaacgagactctgtacctgttgtataacagagagggacagaccctggtggagcggtcctccacctgggtgaagaaggtgatctggtatctgagcggcagaaaccagaccatcctgcagcggatgccaaggaccgctagcaagccaagcgacggcaatgtgcagattagcgtggaggatgctaagattttcggcgcacacatggttcctaagcagaccaagctgttacggttcgtggtgaacgatggaactcggtaccaaatgtgcgtgatgaagctggagtcatgggcacatgtgttccgtgactactctgtttctttccaggtgcgcctgaccttcaccgaggccaataaccagacatacaccttctgtacgcacccaaatctgatcgta

SEQ ID NO: 201 - DNA, 642 bp, Artificial Sequence
  Synthetic polypeptide
atgctcagacttttgctcagacaccacttccactgtttgttgttatgtgccgtgtgggctaccccttgcctcgcatctccgtggtccacactcacagccaaccagaatccttctcctccttggagcaagctcacatatagcaagcctcacgacgcggcaaccttctactgcccattcctgtatccttctcctccgcggagccctctgcagttctccggattccagagagtgtccaccggtcctgagtgcagaaatgaaacactgtatcttctctacaacagagagggccagacccttgtggagagaagcagcacctgggtgaagaaggtcatttggtatctgtctggcagaaaccagaccatactgcagcggatgccaagaacagcctccaagccatccgacggtaacgtgcagatctccgtggaggacgccaagattttcggcgcccacatggtgccaaagcagaccaagctgctgagattcgtggtgaacgatggcaccaggtaccagatgtgcgttatgaagcttgagtcctgggctcacgtgttcagagactactctgtgagcttccaggtgagactgacattcacagaggccaacaaccagacttacaccttctgcacgcatcctaatctgatcgtg

SEQ ID NO: 202 - DNA, 642 bp, Artificial Sequence
  Synthetic polypeptide
atgctcagacttcttctcagacaccacttccactgtttgcttctctgcgcagtgtgggcaaccccttgccttgcttccccttggtcgactctcaccgccaaccagaatccaagccctccttggagcaagctcacttacagcaagccgcacgacgccgccaccttctactgtcctttcctgtaccctagccctccaagatctcctctgcaattctctggattccagagagtgagcaccggcccagagtgccggaacgagactctgtatctgctgtacaatagggagggacaaaccctggtggagaggagcagcacatgggtgaagaaggtgatctggtacctgagcggcagaaaccagaccatcctgcagagaatgccacggaccgccagcaagccaagcgatggcaacgtccagattagcgtggaagacgccaagatcttcggagcccacatggtgcctaagcagaccaagcttctgcgattcgtggtgaacgacggtacccgctaccaaatgtgcgtgatgaagctggagtcatgggcccacgtcttccgcgactacagcgtatccttccaggtgaggcttaccttcaccgaggccaacaaccaaacctacacattctgcacccatccaaatttgattgtg

SEQ ID NO: 203 - DNA, 642 bp, Artificial Sequence
  Synthetic polypeptide
atgctcagactattgttgagacatcacttccattgcctccttttgtgcgccgtgtgggctaccccttgcctcgcctcaccttggagcaccttgaccgccaaccagaacccgagccctccgtggtcaaagctcacctacagcaagcctcacgacgccgcaaccttctattgtccattcctgtacccttctccgccgaggtcccctcttcagttcagcggattccagagagtgtctaccggaccagaatgcagaaacgaaacactgtatctgctgtacaaccgggagggccagaccctggtcgagcggagctctacctgggtcaagaaggttatatggtatctgagcggcaggaaccagaccatcctgcagcgcatgcctagaaccgctagcaagccaagcgacggcaacgttcagatctccgtggaggacgctaagatcttcggcgcccatatggtgccaaagcagactaagctgctgagattcgtggtaaacgacggcacaagatatcagatgtgcgtgatgaagctggagagctgggctcatgtgttcagggactactccgtgagtttccaggtgaggctgacattcaccgaggctaataatcagacctacaccttctgcactcacccaaatctgatcgtg

SEQ ID NO: 204 - DNA, 642 bp, Artificial Sequence
  Synthetic polypeptide
atgctcagattattgctcagacaccacttccactgcctcctcttgtgcgccgtgtgggcgacaccgtgtctcgcaagcccttggtccacactaacggccaaccagaaccctagccctccttggagcaagctcacttatagcaagccacacgatgcggccactttctactgtcctttcctgtatccatcccctcctagatctcctctgcagttcagcggattccagagagtatctactggccctgagtgcagaaatgaaaccctctatctcctgtacaatcgggagggccagactttggtggagcgcagctccacctgggtgaagaaggtgatctggtacctgagcggcagaaaccagaccatcctacagaggatgccaaggaccgccagcaagccatctgacggcaacgtgcagatctctgtggaggacgccaagatcttcggagcccatatggtgcctaagcagacaaagctgttgaggttcgtcgtgaatgacggcacaagataccagatgtgtgtgatgaagctggagagctgggctcacgtgttccgagactacagcgtctcgttccaggtgagactgacattcaccgaggcaaacaaccagacctacaccttctgtacgcaccctaacctgatcgtt

SEQ ID NO: 205 - DNA, 642 bp, Artificial Sequence
  Synthetic polypeptide
atgcttcggctcctccttcggcaccacttccactgcctcctcctctgcgccgtgtgggccacaccttgcctcgccagcccctggagcaccctcaccgccaaccagaaccccagccctccgtggtctaagttaacctacagcaagccccacgacgccgccaccttctactgccccttcctgtacccttcaccgccgcggagcccgctgcagttcagcggcttccagcgggtgagcaccggccccgagtgccggaacgagacgctgtacctgctgtacaaccgggagggccagaccctggtggagcggagcagcacctgggtgaagaaggtgatctggtacctgagcggccggaaccagaccatcctgcagcggatgccccggaccgcctcaaagccaagcgacggcaacgtgcagatcagcgtggaggacgccaagatcttcggcgcccacatggtgcccaagcagaccaagttgctgcgcttcgtggtgaacgacggcacccggtaccagatgtgcgtgatgaagctggagagctgggcccacgtgttccgggactacagcgtgagcttccaggtgcggctgacattcaccgaggccaacaatcagacctacaccttctgcacccaccccaacctgatcgtg

SEQ ID NO: 206 - DNA, 642 bp, Artificial Sequence
  Synthetic polypeptide
atgttacggctccttctccgccaccacttccactgcctcttactctgcgccgtgtgggccactccatgccttgccagcccctggagcaccttgaccgccaaccagaaccccagcccaccttggagtaagctcacctacagcaagccccacgacgccgccaccttctactgccccttcctgtatccgagcccaccgcggagcccgctgcagttcagcggcttccagcgggtgagcaccggccccgagtgccggaacgaaaccctgtacctgctgtacaaccgggagggccagaccctggtggagcggagcagcacctgggtgaagaaggtgatctggtacctgagcggccggaaccagaccatcctgcagcggatgccccggaccgctagtaagcctagcgacggcaacgtgcagatcagcgtggaggacgccaagatcttcggcgcccacatggtgcccaagcagaccaagctgcttaggttcgtggtgaacgacggcacccggtaccagatgtgcgtgatgaagctggagagctgggcccacgtgttccgggactacagcgtgagcttccaggtgcggctgaccttcaccgaggccaacaaccagacatacaccttctgcacccaccccaacctgatcgtg

SEQ ID NO: 207 - DNA, 642 bp, Artificial Sequence
  Synthetic polypeptide
atgctacggctcctactccgccaccacttccactgcttacttttgtgcgccgtgtgggccacaccatgcttggccagcccctggagcaccctcaccgccaaccagaacccctcacctccctggtccaagctcacctactccaagccccacgacgccgccaccttctactgccccttcctctatccatctcctccacgcagcccactccagttctccggcttccagcgcgtctccaccggccccgagtgccgcaacgagacgctctacctcctctacaaccgcgagggccagaccctcgtcgagaggtcatccacctgggtcaagaaggtcatctggtacctctccggccgcaaccagaccatcctccagcgcatgccccgcaccgcgtctaagccgtccgacggcaacgtccagatctccgtcgaggacgccaagatcttcggcgcccacatggtccccaagcagaccaagctcctccgcttcgtcgtcaacgacggcacccgctaccagatgtgcgtcatgaagctcgagtcctgggcccacgtcttccgcgactactccgtctccttccaggtccgcctcaccttcaccgaggccaataaccagacttacaccttctgcacccaccccaacctcatcgtc

SEQ ID NO: 208 - DNA, 642 bp, Artificial Sequence; identical to SEQ ID NO: 207
  Synthetic polypeptide

SEQ ID NO: 209 - DNA, 642 bp, Artificial Sequence
  Synthetic polypeptide
atgcttcggctcctcctaaggcaccacttccactgccttttgctttgcgccgtgtgggccaccccttgcttggccagcccctggagcaccctcaccgccaaccagaacccctcccctccctggtccaagctcacctactccaagccccacgacgccgccaccttctactgccccttcctctacccgtcccctccacgcagcccactccagttctccggcttccagcgcgtctccaccggccccgagtgccgcaacgaaacactctacctcctctacaaccgcgagggccagaccctcgtcgagcgctcctccacctgggtcaagaaggtcatctggtacctctccggccgcaaccagaccatcctccagcgcatgccccgcaccgcaagcaagccatccgacggcaacgtccagatctccgtcgaggacgccaagatcttcggcgcccacatggtccccaagcagaccaagctcctccgcttcgtcgtcaacgacggcacccgctaccagatgtgcgtcatgaagctcgagtcctgggcccacgtcttccgcgactactccgtctccttccaggtccgcctcaccttcaccgaggccaataatcagacatacaccttctgcacccaccccaacctcatcgtc

SEQ ID NO: 210 - DNA, 387 bp, Artificial Sequence
  Synthetic polypeptide
atgcggctgtgtcgggtgtggctgtctgtttgtctgtgcgccgtggtgctgggtcagtgccagcgggaaaccgcggaaaagaacgattattaccgagtaccgcattactgggacgcgtgctctcgcgcgctgcccgaccaaacccgttacaagtatgtggaacagctcgtggacctcacgttgaactaccactacgatgcgagccacggcttggacaactttgacgtgctcaagagaatcaacgtgaccgaggtgtcgttgctcatcagcgactttagacgtcagaaccgtcgcggcggcaccaacaaaaggaccacgttcaacgccgccggttcgctggcgccacacgcccggagcctcgagttcagcgtgcggctctttgccaac

SEQ ID NO: 211 - protein, 742 aa, Artificial Sequence
  Synthetic polypeptide
MRPGLPSYLIILAVCLFSHLLSSRYGAEAVSEPLDKAFHLLLNTYGRPIRFLRENTTQCTYNSSLRNSTVVRENAISFNFFQSYNQYYVFHMPRCLFAGPLAEQFLNQVDLTETLERYQQRLNTYALVSKDLASYRSFSQQLKAQDSLGEQPTTVPPPIDLSIPHVWMPPQTTPHGWTESHTTSGLHRPHFNQTCILFDGHDLLFSTVTPCLHQGFYLIDELRYVKITLTEDFFVVTVSIDDDTPMLLIFGHLPRVLFKAPYQRDNFILRQTEKHELLVLVKKDQLNRHSYLKDPDFLDAALDFNYLDLSALLRNSFHRYAVDVLKSGRCQMLDRRTVEMAFAYALALFAAARQEEAGAQVSVPRALDRQAALLQIQEFMITCLSQTPPRTTLLLYPTAVDLAKRALWTPNQITDITSLVRLVYILSKQNQQHLIPQWALRQIADFALKLHKTHLASFLSAFARQELYLMGSLVHSMLVHTTERREIFIVETGLCSLAELSHFTQLLAHPHHEYLSDLYTPCSSSGRRDHSLERLTRLFPDATVPATVPAALSILSTMQPSTLETFPDLFCLPLGESFSALTVSEHVSYIVTNQYLIKGISYPVSTTVVGQSLIITQTDSQTKCELTRNMHTTHSITVALNISLENCAFCQSALLEYDDTQGVINIMYMHDSDDVLFALDPYNEVVVSSPRTHYLMLLKNGTVLEVTDVVVDATDSRLLMMSVYALSAIIGIYLLYRMLKTC

SEQ ID NO: 212 - protein, 278 aa, Artificial Sequence
  Synthetic polypeptide
MCRRPDCGFSFSPGPVILLWCCLLLPIVSSAAVSVAPTAAEKVPAECPELTRRCLLGEVFEGDKYESWLRPLVNVTGRDGPLSQLIRYRPVTPEAANSVLLDEAFLDTLALLYNNPDQLRALLTLLSSDTAPRWMTVMRGYSECGDGSPAVYTCVDDLCRGYDLTRLSYGRSIFTEHVLGFELVPPSLFNVVVAIRNEATRTNRAVRLPVSTAAAPEGITLFYGLYNAVKEFCLRHQLDPPLLRHLDKYYAGLPPELKQTRVNLPAHSRYGPQAVDAR

SEQ ID NO: 213 - protein, 171 aa, Artificial Sequence
  Synthetic polypeptide
MSPKDLTPFLTALWLLLGHSRVPRVRAEECCEFINVNHPPERCYDFKMCNRFTVALRCPDGEVCYSPEKTAEIRGIVTTMTHSLTRQVVHNKLTSCNYNPLYLEADGRIRCGKVNDKAQYLLGAAGSVPYRWINLEYDKITRIVGLDQYLESVKKHKRLDVCRAKMGYMLQ

SEQ ID NO: 214 - protein, 214 aa, Artificial Sequence
  Synthetic polypeptide
MLRLLLRHHFHCLLLCAVWATPCLASPWSTLTANQNPSPPWSKLTYSKPHDAATFYCPFLYPSPPRSPLQFSGFQRVSTGPECRNETLYLLYNREGQTLVERSSTWVKKVIWYLSGRNQTILQRMPRTASKPSDGNVQISVEDAKIFGAHMVPKQTKLLRFVVNDGTRYQMCVMKLESWAHVFRDYSVSFQVRLTFTEANNQTYTFCTHPNLIV

SEQ ID NO: 215 - protein, 129 aa, Artificial Sequence
  Synthetic polypeptide
MRLCRVWLSVCLCAVVLGQCQRETAEKNDYYRVPHYWDACSRALPDQTRYKYVEQLVDLTLNYHYDASHGLDNFDVLKRINVTEVSLLISDFRRQNRRGGTNKRTTFNAAGSLAPHARSLEFSVRLFAN

SEQ ID NO: 216 - protein, 907 aa, Artificial Sequence; identical to SEQ ID NO: 46
  Synthetic polypeptide

SEQ ID NO: 217 - protein, 557 aa, Artificial Sequence
  Synthetic polypeptide
MESRGRRCPEMISVLGPISGHVLKAVFSRGDTPVLPHETRLLQTGIHVRVSQPSLILVSQYTPDSTPCHRGDNQLQVQHTYFTGSEVENVSVNVHNPTGRSICPSQEPMSIYVYALPLKMLNIPSINVHHYPSAAERKHRHLPVADAVIHASGKQMWQARLTVSGLAWTRQQNQWKEPDVYYTSAFVFPTKDVALRHVVCAHELVCSMENTRATKMQVIGDQYVKVYLESFCEDVPSGKLFMHVTLGSDVEEDLTMTRNPQPFMRPHERNGFTVLCPKNMIIKPGKISHIMLDVAFTSHEHFGLLCPKSIPGLSISGNLLMNGQQIFLEVQAIRETVELRQYDPVAALFFFDIDLLLQRGPQYSEHPTFTSQYRIQGKLEYRHTWDRHDEGAAQGDDDVWTSGSDSDEELVTTERKTPRVTGGGAMASASTSAGSASSATACTAGVMTRGRLKAESTVAPEEDTDEDSDNEIHNPAVFTWPPWQAGILARNLVPMVATVQGQNLKYQEFFWDANDIYRIFAELEGVWQPAAQPKRRRHRQDALPGPCIASTPKKHRG

SEQ ID NO: 218 - protein, 900 aa, Artificial Sequence
  Synthetic polypeptide
MESRGRRCPEMISVLGPISGHVLKAVFSRGDTPVLPHETRLLQTGIHVRVSQPSLILVSQYTPDSTPCHRGDNQLQVQHTYFTGSEVENVSVNVHNPTGRSICPSQEPMSIYVYALPLKMLNIPSINVHHYPSAAERKHRHLPVADAVIHASGKQMWQARLTVSGLAWTRQQNQWKEPDVYYTSAFVFPTKDVALRHVVCAHELVCSMENTRATKMQVIGDQYVKVYLESFCEDVPSGKLFMHVTLGSDVEEDLTMTRNPQPFMRPHERNGFTVLCPKNMIIKPGKISHIMLDVAFTSHEHFGLLCPKSIPGLSISGNLLMNGQQIFLEVQAIRETVELRQYDPVAALFFFDIDLLLQRGPQYSEHPTFTSQYRIQGKLEYRHTWDRHDEGAAQGDDDVWTSGSDSDEELVTTERKTPRVTGGGAMASASTSAGRKRKSASSATACTAGVMTRGRLKAESTVAPEEDTDEDSDNEIHNPAVFTWPPWQAGILARNLVPMVATVQGQNLKYQEFFWDANDIYRIFAELEGVWQPAAQPKRRRHRQDALPGPCIASTPKKHRGESSAKRKMDPDNPDEGPSSKVPRPETPVTKATTFLQTMLRKEVNSQLSLGDPLFPELAEESLKTFEQVTEDCNENPEKDVLTELVKQIKVRVDMVRHRIKEHMLKKYTQTEEKFTGAFNMMGGCLQNALDILDKVHEPFEDMKCIGLTMQSMYENYIVPEDKREMWMACIKELHDVSKGAANKLGGALQAKARAKKDELRRKMMYMCYRNIEFFTKNSAFPKTTNGCSQAMAALQNLPQCSPDEIMSYAQKIFKILDEERDKVLTHIDHIFMDILTTCVETMCNEYKVTSDACMMTMYGGISLLSEFCRVLCCYVLEETSVMLAKRPLITKPEVISVMK

SEQ ID NO: 219 - protein, 1047 aa, Artificial Sequence
  Synthetic polypeptide
MESRGRRCPEMISVLGPISGHVLKAVFSRGDTPVLPHETRLLQTGIHVRVSQPSLILVSQYTPDSTPCHRGDNQLQVQHTYFTGSEVENVSVNVHNPTGRSICPSQEPMSIYVYALPLKMLNIPSINVHHYPSAAERKHRHLPVADAVIHASGKQMWQARLTVSGLAWTRQQNQWKEPDVYYTSAFVFPTKDVALRHVVCAHELVCSMENTRATKMQVIGDQYVKVYLESFCEDVPSGKLFMHVTLGSDVEEDLTMTRNPQPFMRPHERNGFTVLCPKNMIIKPGKISHIMLDVAFTSHEHFGLLCPKSIPGLSISGNLLMNGQQIFLEVQAIRETVELRQYDPVAALFFFDIDLLLQRGPQYSEHPTFTSQYRIQGKLEYRHTWDRHDEGAAQGDDDVWTSGSDSDEELVTTERKTPRVTGGGAMASASTSAGSASSATACTAGVMTRGRLKAESTVAPEEDTDEDSDNEIHNPAVFTWPPWQAGILARNLVPMVATVQGQNLKYQEFFWDANDIYRIFAELEGVWQPAAQPKRRRHRQDALPGPCIASTPKKHRGESSAKRKMDPDNPDEGPSSKVPRPETPVTKATTFLQTMLRKEVNSQLSLGDPLFPELAEESLKTFEQVTEDCNENPEKDVLTELVKQIKVRVDMVRHRIKEHMLKKYTQTEEKFTGAFNMMGGCLQNALDILDKVHEPFEDMKCIGLTMQSMYENYIVPEDKREMWMACIKELHDVSKGAANKLGGALQAKARAKKDELRRKMMYMCYRNIEFFTKNSAFPKTTNGCSQAMAALQNLPQCSPDEIMSYAQKIFKILDEERDKVLTHIDHIFMDILTTCVETMCNEYKVTSDACMMTMYGGISLLSEFCRVLCCYVLEETSVMLAKRPLITKPEVISVMKRRIEEICMKVFAQYILGADPLRVCSPSVDDLRAIAEESDEEEAIVAYTLATAGASSSDSLVSPPESPVPATIPLSSVIVAENSDQEESEQSDEEQEEGAQEEREDTVSVKSEPVSEIEEVASEEEEDGAEEPTASGGKSTHPMVTRSKADQ

SEQ ID NO: 220 - protein, 491 aa, Artificial Sequence
  Synthetic polypeptide
MESSAKRKMDPDNPDEGPSSKVPRPETPVTKATTFLQTMLRKEVNSQLSLGDPLFPELAEESLKTFEQVTEDCNENPEKDVLTELVKQIKVRVDMVRHRIKEHMLKKYTQTEEKFTGAFNMMGGCLQNALDILDKVHEPFEDMKCIGLTMQSMYENYIVPEDKREMWMACIKELHDVSKGAANKLGGALQAKARAKKDELRRKMMYMCYRNIEFFTKNSAFPKTTNGCSQAMAALQNLPQCSPDEIMSYAQKIFKILDEERDKVLTHIDHIFMDILTTCVETMCNEYKVTSDACMMTMYGGISLLSEFCRVLCCYVLEETSVMLAKRPLITKPEVISVMKRRIEEICMKVFAQYILGADPLRVCSPSVDDLRAIAEESDEEEAIVAYTLATAGASSSDSLVSPPESPVPATIPLSSVIVAENSDQEESEQSDEEQEEGAQEEREDTVSVKSEPVSEIEEVASEEEEDGAEEPTASGGKSTHPMVTRSKADQ

SEQ ID NO: 221 - protein, 580 aa, Artificial Sequence
  Synthetic polypeptide
MESSAKRKMDPDNPDEGPSSKVPRPETPVTKATTFLQTMLRKEVNSQLSLGDPLFPELAEESLKTFEQVTEDCNENPEKDVLTELGDILAQAVNHAGIDSSSTGPTLTTHSCSVSSAPLNKPTPTSVAVTNTPLPGASATPELSPRKKPRKTTRPFKVIIKPPVPPAPIMLPLIKQEDIKPEPDFTIQYRNKIIDTAGCIVISDSEEEQGEEVETRGATASSPSTGSGTPRVTSPTHPLSQMNHPPLPDPLGRPDEDSSSSSSSSCSSASDSESESEEMKCSSGGGASVTSSHHGRGGFGGAASSSLLSCGHQSSGGASTGPRKKKSKRISELDNEKVRNIMKDKNTPFCTPNVQTRRGRVKIDEVSRMFRHTNRSLEYKNLPFMIPSMHQVLEEAIKVCKTMQVNNKGIQIIYTRNHEVKNEVDQVRCRLGSMCNLALSTPFLMEHTMPVTHPPDVAQRTADACNDGVKAVWNLKELHTHQLCPRSSDYRNMIIHAATPVDLLGALNLCLPLMQKFPKQVMVRIFSTNQGGFMLPIYETAAKAYAVGQFEKPTETPPEDLDTLSLAIEAAIQDLRNKSQ

SEQ ID NO: 222 - protein, 561 aa, Artificial Sequence
  Synthetic polypeptide
MESRGRRCPEMISVLGPISGHVLKAVFSRGDTPVLPHETRLLQTGIHVRVSQPSLILVSQYTPDSTPCHRGDNQLQVQHTYFTGSEVENVSVNVHNPTGRSICPSQEPMSIYVYALPLKMLNIPSINVHHYPSAAERKHRHLPVADAVIHASGKQMWQARLTVSGLAWTRQQNQWKEPDVYYTSAFVFPTKDVALRHVVCAHELVCSMENTRATKMQVIGDQYVKVYLESFCEDVPSGKLFMHVTLGSDVEEDLTMTRNPQPFMRPHERNGFTVLCPKNMIIKPGKISHIMLDVAFTSHEHFGLLCPKSIPGLSISGNLLMNGQQIFLEVQAIRETVELRQYDPVAALFFFDIDLLLQRGPQYSEHPTFTSQYRIQGKLEYRHTWDRHDEGAAQGDDDVWTSGSDSDEELVTTERKTPRVTGGGAMASASTSAGRKRKSASSATACTAGVMTRGRLKAESTVAPEEDTDEDSDNEIHNPAVFTWPPWQAGILARNLVPMVATVQGQNLKYQEFFWDANDIYRIFAELEGVWQPAAQPKRRRHRQDALPGPCIASTPKKHRG

SEQ ID NO: 223 - protein, 698 aa, Artificial Sequence
  Synthetic polypeptide
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQHHHHHH

SEQ ID NO: 224 - protein, 742 aa, Artificial Sequence; identical to SEQ ID NO: 211
  Synthetic polypeptide

SEQ ID NO: 225 - DNA, 2464 bp, Artificial Sequence
  Synthetic polypeptide
tcaagcttttggaccctcgtacagaagctaatacgactcactatagggaaataagagagaaaagaagagtaagaagaaatataagagccaccatgcggccaggcctcccctcctacctcatcatcctcgccgtctgtctcttcagccacctactttcgtcacgatatggcgcagaagccgtatccgaaccgctggacaaagcgtttcacctactgctcaacacctacgggagacccatccgcttcctgcgtgaaaataccacccagtgtacctacaacagcagcctccgtaacagcacggtcgtcagggaaaacgccatcagtttcaactttttccaaagctataatcaatactatgtattccatatgcctcgatgtctttttgcgggtcctctggcggagcagtttctgaaccaggtagatctgaccgaaaccctggaaagataccaacagagacttaacacttacgcgctggtatccaaagacctggccagctaccgatctttttcgcagcagctaaaggcacaagacagcctaggtgaacagcccaccactgtgccaccgcccattgacctgtcaatacctcacgtttggatgccaccgcaaaccactccacacggctggacagaatcacataccacctcaggactacaccgaccacactttaaccagacctgtatcctctttgatggacacgatctactattcagcaccgtcacaccttgtttgcaccaaggcttttacctcatcgacgaactacgttacgttaaaataacactgaccgaggacttcttcgtagttacggtgtccatagacgacgacacacccatgctgcttatcttcggccatcttccacgcgtacttttcaaagcgccctatcaacgcgacaactttatactacgacaaactgaaaaacacgagctcctggtgctagttaagaaagatcaactgaaccgtcactcttatctcaaagacccggactttcttgacgccgcacttgacttcaactacctagacctcagcgcactactacgtaacagctttcaccgttacgccgtggatgtactcaagagcggtcgatgtcagatgctggaccgccgcacggtagaaatggccttcgcctacgcattagcactgttcgcagcagcccgacaagaagaggccggcgcccaagtctccgtcccacgggccctagaccgccaggccgcactcttacaaatacaagaatttatgatcacctgcctctcacaaacaccaccacgcaccacgttgctgctgtatcccacggccgtggacctggccaaacgagccctttggacaccgaatcagatcaccgacatcaccagcctcgtacgcctggtctacatactctctaaacagaatcagcaacatctcatcccccaatgggcactacgacagatcgccgactttgccctaaaactacacaaaacgcacctggcctcttttctttcagccttcgcacgccaagaactctacctcatgggcagcctcgtccactccatgctggtacatacgacggagagacgcgaaatcttcatcgtagaaacgggcctctgttcattggccgagctatcacactttacgcagttgttagctcatccacaccacgaatacctcagcgacctgtacacaccctgttccagtagcgggcgacgcgatcactcgctcgaacgcctcacgcgtctcttccccgatgccaccgtccccgctaccgttcccgccgccctctccatcctatctaccatgcaaccaagcacgctggaaaccttccccgacctgttttgcttgccgctcggcgaatccttctccgcgctgaccgtctccgaacacgtcagttatatcgtaacaaaccagtacctgatcaaaggtatctcctaccctgtctccaccaccgtcgtaggccagagcctcatcatcacccagacggacagtcaaactaaatgcgaactgacgcgcaacatgcataccacacacagcatcacagtggcgctcaacatttcgctagaaaactgcgccttttgccaaagcgccctgctagaatacgacgacacgcaaggcgtcatcaacatcatgtacatgcacgactcggacgacgtccttttcgccctggatccctacaacgaagtggtggtctcatctccgcgaactcactacctcatgcttttgaaaaacggtacggtactagaagtaactgacgtcgtcgtggacgccaccgacagtcgtctcctcatgatgtccgtctacgcgctatcggccatcatcggcatctatctgctctaccgcatgctcaagacatgcgattacaaggacgatgacgataagtgatgataataggctggagcctcggtggccatgcttcttgccccttgggcctccccccagcccctcctccccttcctgcacccgtacccccgtggtctttgaataaagtctgagtgggcggc

SEQ ID NO: 226 - DNA, 1045 bp, Artificial Sequence; identical to SEQ ID NO: 142
  Synthetic polypeptide

SEQ ID NO: 227 - DNA, 1072 bp, Artificial Sequence
  Synthetic polypeptide
tcaagcttttggaccctcgtacagaagctaatacgactcactatagggaaataagagagaaaagaagagtaagaagaaatataagagccaccatgtgccgccgcccggattgcggcttctctttctcacctggaccggtgatactgctgtggtgttgccttctgctgcccattgtttcctcagccgccgtcagcgtcgctcctaccgccgccgagaaagtccccgcggagtgccccgaactaacgcgccgatgcttgttgggtgaggtgtttgagggtgacaagtatgaaagttggctgcgcccgttggtgaatgttaccgggcgcgatggcccgctatcgcaacttatccgttaccgtcccgttacgccggaggccgccaactccgtgctgttggacgaggctttcctggacactctggccctgctgtacaacaatccggatcaattgcgggccctgctgacgctgttgagctcggacacagcgccgcgctggatgacggtgatgcgcggctacagcgagtgcggcgatggctcgccggccgtgtacacgtgcgtggacgacctgtgccgcggctacgacctcacgcgactgtcatacgggcgcagcatcttcacggaacacgtgttaggcttcgagctggtgccaccgtctctctttaacgtggtggtggccatacgcaacgaagccacgcgtaccaaccgcgccgtgcgtctgcccgtgagcaccgctgccgcgcccgagggcatcacgctcttttacggcctgtacaacgcagtgaaggaattctgcctgcgtcaccagctggacccgccgctgctacgccacctagataaatactacgccggactgccgcccgagctgaagcagacgcgcgtcaacctgccggctcactcgcgctatggccctcaagcagtggatgctcgcgattacaaggacgatgacgataagtgatgataataggctggagcctcggtggccatgcttcttgccccttgggcctccccccagcccctcctccccttcctgcacccgtacccccgtggtctttgaataaagtctgagtgggcggc

SEQ ID NO: 228 - DNA, 2932 bp, Artificial Sequence
  Synthetic polypeptide
tcaagcttttggaccctcgtacagaagctaatacgactcactatagggaaataagagagaaaagaagagtaagaagaaatataagagccaccatggaatccaggatctggtgcctggtagtctgcgttaacttgtgtatcgtctgtctgggtgctgcggtttcctcatcttctactcgtggaacttctgctactcacagtcaccattcctctcatacgacgtctgctgctcactctcgatccggttcagtctctcaacgcgtaacttcttcccaaacggtcagccatggtgttaacgagaccatctacaacactaccctcaagtacggagatgtggtgggggtcaataccaccaagtacccctatcgcgtgtgttctatggcccagggtacggatcttattcgctttgaacgtaatatcgtctgcacctcgatgaagcccatcaatgaagacctggacgagggcatcatggtggtctacaaacgcaacatcgtcgcgcacacctttaaggtacgagtctaccagaaggttttgacgtttcgtcgtagctacgcttacatccacaccacttatctgctgggcagcaacacggaatacgtggcgcctcctatgtgggagattcatcatatcaacagccacagtcagtgctacagttcctacagccgcgttatagcaggcacggttttcgtggcttatcatagggacagctatgaaaacaaaaccatgcaattaatgcccgacgattattccaacacccacagtacccgttacgtgacggtcaaggatcaatggcacagccgcggcagcacctggctctatcgtgagacctgtaatctgaattgtatggtgaccatcactactgcgcgctccaaatatccttatcattttttcgccacttccacgggtgacgtggttgacatttctcctttctacaacggaaccaatcgcaatgccagctactttggagaaaacgccgacaagtttttcatttttccgaactacactatcgtctccgactttggaagaccgaattctgcgttagagacccacaggttggtggcttttcttgaacgtgcggactcggtgatctcctgggatatacaggacgaaaagaatgtcacttgtcaactcactttctgggaagcctcggaacgcaccattcgttccgaagccgaggactcgtatcacttttcttctgccaaaatgaccgccactttcttatctaagaagcaagaggtgaacatgtccgactctgcgctggactgcgtacgtgatgaggctataaataagttacagcagattttcaatacttcatacaatcaaacatatgaaaaatatggaaacgtgtccgtctttgaaaccactggtggtttggtagtgttctggcaaggtatcaagcaaaaatctctggtggaactcgaacgtttggccaaccgctccagtctgaatcttactcataatagaaccaaaagaagtacagatggcaacaatgcaactcatttatccaacatggaatcggtgcacaatctggtctacgcccagctgcagttcacctatgacacgttgcgcggttacatcaaccgggcgctggcgcaaatcgcagaagcctggtgtgtggatcaacggcgcaccctagaggtcttcaaggaactcagcaagatcaacccgtcagccattctctcggccatttacaacaaaccgattgccgcgcgtttcatgggtgatgtcttgggcctggccagctgcgtgaccatcaaccaaaccagcgtcaaggtgctgcgtgatatgaacgtgaaggagtcgccaggacgctgctactcacgacccgtggtcatctttaatttcgccaacagctcgtacgtgcagtacggtcaactgggcgaggacaacgaaatcctgttgggcaaccaccgcactgaggaatgtcagcttcccagcctcaagatcttcatcgccgggaactcggcctacgagtacgtggactacctcttcaaacgcatgattgacctcagcagtatctccaccgtcgacagcatgatcgccctggatatcgacccgctggaaaataccgacttcagggtactggaactttactcgcagaaagagctgcgttccagcaacgtttttgacctcgaagagatcatgcgcgaattcaactcgtacaagcagcgggtaaagtacgtggaggacaaggtagtcgacccgctaccgccctacctcaagggtctggacgacctcatgagcggcctgggcgccgcgggaaaggccgttggcgtagccattggggccgtgggtggcgcggtggcctccgtggtcgaaggcgttgccaccttcctcaaaaaccccttcggagcgttcaccatcatcctcgtggccatagctgtagtcattatcacttatttgatctatactcgacagcggcgtttgtgcacgcagccgctgcagaacctctttccctatctggtgtccgccgacgggaccaccgtgacgtcgggcagcaccaaagacacgtcgttacaggctccgccttcctacgaggaaagtgtttataattctggtcgcaaaggaccgggaccaccgtcgtctgatgcatccacggcggctccgccttacaccaacgagcaggcttaccagatgcttctggccctggcccgtctggacgcagagcagcgagcgcagcagaacggtacagattctttggacggacggactggcacgcaggacaagggacagaagcccaacctactagaccgactgcgacatcgcaaaaacggctaccgacacttgaaagactctgacgaagaagagaacgtctgataataggctggagcctcggtggccatgcttcttgccccttgggcctccccccagcccctcctccccttcctgcacccgtacccccgtggtctttgaataaagtctgagtgggcggc

SEQ ID NO: 229 - DNA, 2956 bp, Artificial Sequence
  Synthetic polypeptide
tcaagcttttggaccctcgtacagaagctaatacgactcactatagggaaataagagagaaaagaagagtaagaagaaatataagagccaccatggaatccaggatctggtgcctggtagtctgcgttaacttgtgtatcgtctgtctgggtgctgcggtttcctcatcttctactcgtggaacttctgctactcacagtcaccattcctctcatacgacgtctgctgctcactctcgatccggttcagtctctcaacgcgtaacttcttcccaaacggtcagccatggtgttaacgagaccatctacaacactaccctcaagtacggagatgtggtgggggtcaataccaccaagtacccctatcgcgtgtgttctatggcccagggtacggatcttattcgctttgaacgtaatatcgtctgcacctcgatgaagcccatcaatgaagacctggacgagggcatcatggtggtctacaaacgcaacatcgtcgcgcacacctttaaggtacgagtctaccagaaggttttgacgtttcgtcgtagctacgcttacatccacaccacttatctgctgggcagcaacacggaatacgtggcgcctcctatgtgggagattcatcatatcaacagccacagtcagtgctacagttcctacagccgcgttatagcaggcacggttttcgtggcttatcatagggacagctatgaaaacaaaaccatgcaattaatgcccgacgattattccaacacccacagtacccgttacgtgacggtcaaggatcaatggcacagccgcggcagcacctggctctatcgtgagacctgtaatctgaattgtatggtgaccatcactactgcgcgctccaaatatccttatcattttttcgccacttccacgggtgacgtggttgacatttctcctttctacaacggaaccaatcgcaatgccagctactttggagaaaacgccgacaagtttttcatttttccgaactacactatcgtctccgactttggaagaccgaattctgcgttagagacccacaggttggtggcttttcttgaacgtgcggactcggtgatctcctgggatatacaggacgaaaagaatgtcacttgtcaactcactttctgggaagcctcggaacgcaccattcgttccgaagccgaggactcgtatcacttttcttctgccaaaatgaccgccactttcttatctaagaagcaagaggtgaacatgtccgactctgcgctggactgcgtacgtgatgaggctataaataagttacagcagattttcaatacttcatacaatcaaacatatgaaaaatatggaaacgtgtccgtctttgaaaccactggtggtttggtagtgttctggcaaggtatcaagcaaaaatctctggtggaactcgaacgtttggccaaccgctccagtctgaatcttactcataatagaaccaaaagaagtacagatggcaacaatgcaactcatttatccaacatggaatcggtgcacaatctggtctacgcccagctgcagttcacctatgacacgttgcgcggttacatcaaccgggcgctggcgcaaatcgcagaagcctggtgtgtggatcaacggcgcaccctagaggtcttcaaggaactcagcaagatcaacccgtcagccattctctcggccatttacaacaaaccgattgccgcgcgtttcatgggtgatgtcttgggcctggccagctgcgtgaccatcaaccaaaccagcgtcaaggtgctgcgtgatatgaacgtgaaggagtcgccaggacgctgctactcacgacccgtggtcatctttaatttcgccaacagctcgtacgtgcagtacggtcaactgggcgaggacaacgaaatcctgttgggcaaccaccgcactgaggaatgtcagcttcccagcctcaagatcttcatcgccgggaactcggcctacgagtacgtggactacctcttcaaacgcatgattgacctcagcagtatctccaccgtcgacagcatgatcgccctggatatcgacccgctggaaaataccgacttcagggtactggaactttactcgcagaaagagctgcgttccagcaacgtttttgacctcgaagagatcatgcgcgaattcaactcgtacaagcagcgggtaaagtacgtggaggacaaggtagtcgacccgctaccgccctacctcaagggtctggacgacctcatgagcggcctgggcgccgcgggaaaggccgttggcgtagccattggggccgtgggtggcgcggtggcctccgtggtcgaaggcgttgccaccttcctcaaaaaccccttcggagcgttcaccatcatcctcgtggccatagctgtagtcattatcacttatttgatctatactcgacagcggcgtttgtgcacgcagccgctgcagaacctctttccctatctggtgtccgccgacgggaccaccgtgacgtcgggcagcaccaaagacacgtcgttacaggctccgccttcctacgaggaaagtgtttataattctggtcgcaaaggaccgggaccaccgtcgtctgatgcatccacggcggctccgccttacaccaacgagcaggcttaccagatgcttctggccctggcccgtctggacgcagagcagcgagcgcagcagaacggtacagattctttggacggacggactggcacgcaggacaagggacagaagcccaacctactagaccgactgcgacatcgcaaaaacggctaccgacacttgaaagactctgacgaagaagagaacgtcgattacaaggacgatgacgataagtgataataggctggagcctcggtggccatgcttcttgccccttgggcctccccccagcccctcctccccttcctgcacccgtacccccgtggtctttgaataaagtctgagtgggcggc

SEQ ID NO: 230 - DNA, 2356 bp, Artificial Sequence
  Synthetic polypeptide
tcaagcttttggaccctcgtacagaagctaatacgactcactatagggaaataagagagaaaagaagagtaagaagaaatataagagccaccatgcggccaggcctcccctcctacctcatcatcctcgccgtctgtctcttcagccacctactttcgtcacgatatggcgcagaagccgtatccgaaccgctggacaaagcgtttcacctactgctcaacacctacgggagacccatccgcttcctgcgtgaaaataccacccagtgtacctacaacagcagcctccgtaacagcacggtcgtcagggaaaacgccatcagtttcaactttttccaaagctataatcaatactatgtattccatatgcctcgatgtctttttgcgggtcctctggcggagcagtttctgaaccaggtagatctgaccgaaaccctggaaagataccaacagagacttaacacttacgcgctggtatccaaagacctggccagctaccgatctttttcgcagcagctaaaggcacaagacagcctaggtgaacagcccaccactgtgccaccgcccattgacctgtcaatacctcacgtttggatgccaccgcaaaccactccacacggctggacagaatcacataccacctcaggactacaccgaccacactttaaccagacctgtatcctctttgatggacacgatctactattcagcaccgtcacaccttgtttgcaccaaggcttttacctcatcgacgaactacgttacgttaaaataacactgaccgaggacttcttcgtagttacggtgtccatagacgacgacacacccatgctgcttatcttcggccatcttccacgcgtacttttcaaagcgccctatcaacgcgacaactttatactacgacaaactgaaaaacacgagctcctggtgctagttaagaaagatcaactgaaccgtcactcttatctcaaagacccggactttcttgacgccgcacttgacttcaactacctagacctcagcgcactactacgtaacagctttcaccgttacgccgtggatgtactcaagagcggtcgatgtcagatgctggaccgccgcacggtagaaatggccttcgcctacgcattagcactgttcgcagcagcccgacaagaagaggccggcgcccaagtctccgtcccacgggccctagaccgccaggccgcactcttacaaatacaagaatttatgatcacctgcctctcacaaacaccaccacgcaccacgttgctgctgtatcccacggccgtggacctggccaaacgagccctttggacaccgaatcagatcaccgacatcaccagcctcgtacgcctggtctacatactctctaaacagaatcagcaacatctcatcccccaatgggcactacgacagatcgccgactttgccctaaaactacacaaaacgcacctggcctcttttctttcagccttcgcacgccaagaactctacctcatgggcagcctcgtccactccatgctggtacatacgacggagagacgcgaaatcttcatcgtagaaacgggcctctgttcattggccgagctatcacactttacgcagttgttagctcatccacaccacgaatacctcagcgacctgtacacaccctgttccagtagcgggcgacgcgatcactcgctcgaacgcctcacgcgtctcttccccgatgccaccgtccccgctaccgttcccgccgccctctccatcctatctaccatgcaaccaagcacgctggaaaccttccccgacctgttttgcttgccgctcggcgaatccttctccgcgctgaccgtctccgaacacgtcagttatatcgtaacaaaccagtacctgatcaaaggtatctcctaccctgtctccaccaccgtcgtaggccagagcctcatcatcacccagacggacagtcaaactaaatgcgaactgacgcgcaacatgcataccacacacagcatcacagtggcgctcaacatttcgctagaaaactgcgccttttgccaaagcgccctgctagaatacgacgacacgcaaggcgtcatcaacatcatgtacatgcacgactcggacgacgtccttttcgccctggatccctacaacgaagtggtggtctcatctccgcgaactcactacctcatgcttttgaaaaacggtacggtactagaagtaactgacgtcgtcgtggacgccaccgactgataataggctggagcctcggtggccatgcttcttgccccttgggcctccccccagcccctcctccccttcctgcacccgtacccccgtggtctttgaataaagtctgagtgggcggc

SEQ ID NO: 231 - DNA, 2383 bp, Artificial Sequence
  Synthetic polypeptide
tcaagcttttggaccctcgtacagaagctaatacgactcactatagggaaataagagagaaaagaagagtaagaagaaatataagagccaccatgcggccaggcctcccctcctacctcatcatcctcgccgtctgtctcttcagccacctactttcgtcacgatatggcgcagaagccgtatccgaaccgctggacaaagcgtttcacctactgctcaacacctacgggagacccatccgcttcctgcgtgaaaataccacccagtgtacctacaacagcagcctccgtaacagcacggtcgtcagggaaaacgccatcagtttcaactttttccaaagctataatcaatactatgtattccatatgcctcgatgtctttttgcgggtcctctggcggagcagtttctgaaccaggtagatctgaccgaaaccctggaaagataccaacagagacttaacacttacgcgctggtatccaaagacctggccagctaccgatctttttcgcagcagctaaaggcacaagacagcctaggtgaacagcccaccactgtgccaccgcccattgacctgtcaatacctcacgtttggatgccaccgcaaaccactccacacggctggacagaatcacataccacctcaggactacaccgaccacactttaaccagacctgtatcctctttgatggacacgatctactattcagcaccgtcacaccttgtttgcaccaaggcttttacctcatcgacgaactacgttacgttaaaataacactgaccgaggacttcttcgtagttacggtgtccatagacgacgacacacccatgctgcttatcttcggccatcttccacgcgtacttttcaaagcgccctatcaacgcgacaactttatactacgacaaactgaaaaacacgagctcctggtgctagttaagaaagatcaactgaaccgtcactcttatctcaaagacccggactttcttgacgccgcacttgacttcaactacctagacctcagcgcactactacgtaacagctttcaccgttacgccgtggatgtactcaagagcggtcgatgtcagatgctggaccgccgcacggtagaaatggccttcgcctacgcattagcactgttcgcagcagcccgacaagaagaggccggcgcccaagtctccgtcccacgggccctagaccgccaggccgcactcttacaaatacaagaatttatgatcacctgcctctcacaaacaccaccacgcaccacgttgctgctgtatcccacggccgtggacctggccaaacgagccctttggacaccgaatcagatcaccgacatcaccagcctcgtacgcctggtctacatactctctaaacagaatcagcaacatctcatcccccaatgggcactacgacagatcgccgactttgccctaaaactacacaaaacgcacctggcctcttttctttcagccttcgcacgccaagaactctacctcatgggcagcctcgtccactccatgctggtacatacgacggagagacgcgaaatcttcatcgtagaaacgggcctctgttcattggccgagctatcacactttacgcagttgttagctcatccacaccacgaatacctcagcgacctgtacacaccctgttccagtagcgggcgacgcgatcactcgctcgaacgcctcacgcgtctcttccccgatgccaccgtccccgctaccgttcccgccgccctctccatcctatctaccatgcaaccaagcacgctggaaaccttccccgacctgttttgcttgccgctcggcgaatccttctccgcgctgaccgtctccgaacacgtcagttatatcgtaacaaaccagtacctgatcaaaggtatctcctaccctgtctccaccaccgtcgtaggccagagcctcatcatcacccagacggacagtcaaactaaatgcgaactgacgcgcaacatgcataccacacacagcatcacagtggcgctcaacatttcgctagaaaactgcgccttttgccaaagcgccctgctagaatacgacgacacgcaaggcgtcatcaacatcatgtacatgcacgactcggacgacgtccttttcgccctggatccctacaacgaagtggtggtctcatctccgcgaactcactacctcatgcttttgaaaaacggtacggtactagaagtaactgacgtcgtcgtggacgccaccgacgattacaaggacgatgacgataagtgatgataataggctggagcctcggtggccatgcttcttgccccttgggcctccccccagcccctcctccccttcctgcacccgtacccccgtggtctttgaataaagtctgagtgggcggc

SEQ ID NO: 232 - DNA, 2377 bp, Artificial Sequence
  Synthetic polypeptide
tcaagcttttggaccctcgtacagaagctaatacgactcactatagggaaataagagagaaaagaagagtaagaagaaatataagagccaccatgcggccaggcctcccctcctacctcatcatcctcgccgtctgtctcttcagccacctactttcgtcacgatatggcgcagaagccgtatccgaaccgctggacaaagcgtttcacctactgctcaacacctacgggagacccatccgcttcctgcgtgaaaataccacccagtgtacctacaacagcagcctccgtaacagcacggtcgtcagggaaaacgccatcagtttcaactttttccaaagctataatcaatactatgtattccatatgcctcgatgtctttttgcgggtcctctggcggagcagtttctgaaccaggtagatctgaccgaaaccctggaaagataccaacagagacttaacacttacgcgctggtatccaaagacctggccagctaccgatctttttcgcagcagctaaaggcacaagacagcctaggtgaacagcccaccactgtgccaccgcccattgacctgtcaatacctcacgtttggatgccaccgcaaaccactccacacggctggacagaatcacataccacctcaggactacaccgaccacactttaaccagacctgtatcctctttgatggacacgatctactattcagcaccgtcacaccttgtttgcaccaaggcttttacctcatcgacgaactacgttacgttaaaataacactgaccgaggacttcttcgtagttacggtgtccatagacgacgacacacccatgctgcttatcttcggccatcttccacgcgtacttttcaaagcgccctatcaacgcgacaactttatactacgacaaactgaaaaacacgagctcctggtgctagttaagaaagatcaactgaaccgtcactcttatctcaaagacccggactttcttgacgccgcacttgacttcaactacctagacctcagcgcactactacgtaacagctttcaccgttacgccgtggatgtactcaagagcggtcgatgtcagatgctggaccgccgcacggtagaaatggccttcgcctacgcattagcactgttcgcagcagcccgacaagaagaggccggcgcccaagtctccgtcccacgggccctagaccgccaggccgcactcttacaaatacaagaatttatgatcacctgcctctcacaaacaccaccacgcaccacgttgctgctgtatcccacggccgtggacctggccaaacgagccctttggacaccgaatcagatcaccgacatcaccagcctcgtacgcctggtctacatactctctaaacagaatcagcaacatctcatcccccaatgggcactacgacagatcgccgactttgccctaaaactacacaaaacgcacctggcctcttttctttcagccttcgcacgccaagaactctacctcatgggcagcctcgtccactccatgctggtacatacgacggagagacgcgaaatcttcatcgtagaaacgggcctctgttcattggccgagctatcacactttacgcagttgttagctcatccacaccacgaatacctcagcgacctgtacacaccctgttccagtagcgggcgacgcgatcactcgctcgaacgcctcacgcgtctcttccccgatgccaccgtccccgctaccgttcccgccgccctctccatcctatctaccatgcaaccaagcacgctggaaaccttccccgacctgttttgcttgccgctcggcgaatccttctccgcgctgaccgtctccgaacacgtcagttatatcgtaacaaaccagtacctgatcaaaggtatctcctaccctgtctccaccaccgtcgtaggccagagcctcatcatcacccagacggacagtcaaactaaatgcgaactgacgcgcaacatgcataccacacacagcatcacagtggcgctcaacatttcgctagaaaactgcgccttttgccaaagcgccctgctagaatacgacgacacgcaaggcgtcatcaacatcatgtacatgcacgactcggacgacgtccttttcgccctggatccctacaacgaagtggtggtctcatctccgcgaactcactacctcatgcttttgaaaaacggtacggtactagaagtaactgacgtcgtcgtggacgccaccgaccaccatcaccaccatcactgatgataataggctggagcctcggtggccatgcttcttgccccttgggcctccccccagcccctcctccccttcctgcacccgtacccccgtggtctttgaataaagtctgagtgggcggc

SEQ ID NO: 233 - DNA, 2287 bp, Artificial Sequence
  Synthetic polypeptide
tcaagcttttggaccctcgtacagaagctaatacgactcactatagggaaataagagagaaaagaagagtaagaagaaatataagagccaccatggaatccaggatctggtgcctggtagtctgcgttaacttgtgtatcgtctgtctgggtgctgcggtttcctcatcttctactcgtggaacttctgctactcacagtcaccattcctctcatacgacgtctgctgctcactctcgatccggttcagtctctcaacgcgtaacttcttcccaaacggtcagccatggtgttaacgagaccatctacaacactaccctcaagtacggagatgtggtgggggtcaataccaccaagtacccctatcgcgtgtgttctatggcccagggtacggatcttattcgctttgaacgtaatatcgtctgcacctcgatgaagcccatcaatgaagacctggacgagggcatcatggtggtctacaaacgcaacatcgtcgcgcacacctttaaggtacgagtctaccagaaggttttgacgtttcgtcgtagctacgcttacatccacaccacttatctgctgggcagcaacacggaatacgtggcgcctcctatgtgggagattcatcatatcaacagccacagtcagtgctacagttcctacagccgcgttatagcaggcacggttttcgtggcttatcatagggacagctatgaaaacaaaaccatgcaattaatgcccgacgattattccaacacccacagtacccgttacgtgacggtcaaggatcaatggcacagccgcggcagcacctggctctatcgtgagacctgtaatctgaattgtatggtgaccatcactactgcgcgctccaaatatccttatcattttttcgccacttccacgggtgacgtggttgacatttctcctttctacaacggaaccaatcgcaatgccagctactttggagaaaacgccgacaagtttttcatttttccgaactacactatcgtctccgactttggaagaccgaattctgcgttagagacccacaggttggtggcttttcttgaacgtgcggactcggtgatctcctgggatatacaggacgaaaagaatgtcacttgtcaactcactttctgggaagcctcggaacgcaccattcgttccgaagccgaggactcgtatcacttttcttctgccaaaatgaccgccactttcttatctaagaagcaagaggtgaacatgtccgactctgcgctggactgcgtacgtgatgaggctataaataagttacagcagattttcaatacttcatacaatcaaacatatgaaaaatatggaaacgtgtccgtctttgaaaccactggtggtttggtagtgttctggcaaggtatcaagcaaaaatctctggtggaactcgaacgtttggccaaccgctccagtctgaatcttactcataatagaaccaaaagaagtacagatggcaacaatgcaactcatttatccaacatggaatcggtgcacaatctggtctacgcccagctgcagttcacctatgacacgttgcgcggttacatcaaccgggcgctggcgcaaatcgcagaagcctggtgtgtggatcaacggcgcaccctagaggtcttcaaggaactcagcaagatcaacccgtcagccattctctcggccatttacaacaaaccgattgccgcgcgtttcatgggtgatgtcttgggcctggccagctgcgtgaccatcaaccaaaccagcgtcaaggtgctgcgtgatatgaacgtgaaggagtcgccaggacgctgctactcacgacccgtggtcatctttaatttcgccaacagctcgtacgtgcagtacggtcaactgggcgaggacaacgaaatcctgttgggcaaccaccgcactgaggaatgtcagcttcccagcctcaagatcttcatcgccgggaactcggcctacgagtacgtggactacctcttcaaacgcatgattgacctcagcagtatctccaccgtcgacagcatgatcgccctggatatcgacccgctggaaaataccgacttcagggtactggaactttactcgcagaaagagctgcgttccagcaacgtttttgacctcgaagagatcatgcgcgaattcaactcgtacaagcagtgataataggctggagcctcggtggccatgcttcttgccccttgggcctccccccagcccctcctccccttcctgcacccgtacccccgtggtctttgaataaagtctgagtgggcggc

SEQ ID NO: 234 - DNA, 2311 bp, Artificial Sequence
  Synthetic polypeptide
tcaagcttttggaccctcgtacagaagctaatacgactcactatagggaaataagagagaaaagaagagtaagaagaaatataagagccaccatggaatccaggatctggtgcctggtagtctgcgttaacttgtgtatcgtctgtctgggtgctgcggtttcctcatcttctactcgtggaacttctgctactcacagtcaccattcctctcatacgacgtctgctgctcactctcgatccggttcagtctctcaacgcgtaacttcttcccaaacggtcagccatggtgttaacgagaccatctacaacactaccctcaagtacggagatgtggtgggggtcaataccaccaagtacccctatcgcgtgtgttctatggcccagggtacggatcttattcgctttgaacgtaatatcgtctgcacctcgatgaagcccatcaatgaagacctggacgagggcatcatggtggtctacaaacgcaacatcgtcgcgcacacctttaaggtacgagtctaccagaaggttttgacgtttcgtcgtagctacgcttacatccacaccacttatctgctgggcagcaacacggaatacgtggcgcctcctatgtgggagattcatcatatcaacagccacagtcagtgctacagttcctacagccgcgttatagcaggcacggttttcgtggcttatcatagggacagctatgaaaacaaaaccatgcaattaatgcccgacgattattccaacacccacagtacccgttacgtgacggtcaaggatcaatggcacagccgcggcagcacctggctctatcgtgagacctgtaatctgaattgtatggtgaccatcactactgcgcgctccaaatatccttatcattttttcgccacttccacgggtgacgtggttgacatttctcctttctacaacggaaccaatcgcaatgccagctactttggagaaaacgccgacaagtttttcatttttccgaactacactatcgtctccgactttggaagaccgaattctgcgttagagacccacaggttggtggcttttcttgaacgtgcggactcggtgatctcctgggatatacaggacgaaaagaatgtcacttgtcaactcactttctgggaagcctcggaacgcaccattcgttccgaagccgaggactcgtatcacttttcttctgccaaaatgaccgccactttcttatctaagaagcaagaggtgaacatgtccgactctgcgctggactgcgtacgtgatgaggctataaataagttacagcagattttcaatacttcatacaatcaaacatatgaaaaatatggaaacgtgtccgtctttgaaaccactggtggtttggtagtgttctggcaaggtatcaagcaaaaatctctggtggaactcgaacgtttggccaaccgctccagtctgaatcttactcataatagaaccaaaagaagtacagatggcaacaatgcaactcatttatccaacatggaatcggtgcacaatctggtctacgcccagctgcagttcacctatgacacgttgcgcggttacatcaaccgggcgctggcgcaaatcgcagaagcctggtgtgtggatcaacggcgcaccctagaggtcttcaaggaactcagcaagatcaacccgtcagccattctctcggccatttacaacaaaccgattgccgcgcgtttcatgggtgatgtcttgggcctggccagctgcgtgaccatcaaccaaaccagcgtcaaggtgctgcgtgatatgaacgtgaaggagtcgccaggacgctgctactcacgacccgtggtcatctttaatttcgccaacagctcgtacgtgcagtacggtcaactgggcgaggacaacgaaatcctgttgggcaaccaccgcactgaggaatgtcagcttcccagcctcaagatcttcatcgccgggaactcggcctacgagtacgtggactacctcttcaaacgcatgattgacctcagcagtatctccaccgtcgacagcatgatcgccctggatatcgacccgctggaaaataccgacttcagggtactggaactttactcgcagaaagagctgcgttccagcaacgtttttgacctcgaagagatcatgcgcgaattcaactcgtacaagcaggattacaaggacgatgacgataagtgataataggctggagcctcggtggccatgcttcttgccccttgggcctccccccagcccctcctccccttcctgcacccgtacccccgtggtctttgaataaagtctgagtgggcggc

SEQ ID NO: 235 - DNA, 2305 bp, Artificial Sequence
  Synthetic polypeptide
tcaagcttttggaccctcgtacagaagctaatacgactcactatagggaaataagagagaaaagaagagtaagaagaaatataagagccaccatggaatccaggatctggtgcctggtagtctgcgttaacttgtgtatcgtctgtctgggtgctgcggtttcctcatcttctactcgtggaacttctgctactcacagtcaccattcctctcatacgacgtctgctgctcactctcgatccggttcagtctctcaacgcgtaacttcttcccaaacggtcagccatggtgttaacgagaccatctacaacactaccctcaagtacggagatgtggtgggggtcaataccaccaagtacccctatcgcgtgtgttctatggcccagggtacggatcttattcgctttgaacgtaatatcgtctgcacctcgatgaagcccatcaatgaagacctggacgagggcatcatggtggtctacaaacgcaacatcgtcgcgcacacctttaaggtacgagtctaccagaaggttttgacgtttcgtcgtagctacgcttacatccacaccacttatctgctgggcagcaacacggaatacgtggcgcctcctatgtgggagattcatcatatcaacagccacagtcagtgctacagttcctacagccgcgttatagcaggcacggttttcgtggcttatcatagggacagctatgaaaacaaaaccatgcaattaatgcccgacgattattccaacacccacagtacccgttacgtgacggtcaaggatcaatggcacagccgcggcagcacctggctctatcgtgagacctgtaatctgaattgtatggtgaccatcactactgcgcgctccaaatatccttatcattttttcgccacttccacgggtgacgtggttgacatttctcctttctacaacggaaccaatcgcaatgccagctactttggagaaaacgccgacaagtttttcatttttccgaactacactatcgtctccgactttggaagaccgaattctgcgttagagacccacaggttggtggcttttcttgaacgtgcggactcggtgatctcctgggatatacaggacgaaaagaatgtcacttgtcaactcactttctgggaagcctcggaacgcaccattcgttccgaagccgaggactcgtatcacttttcttctgccaaaatgaccgccactttcttatctaagaagcaagaggtgaacatgtccgactctgcgctggactgcgtacgtgatgaggctataaataagttacagcagattttcaatacttcatacaatcaaacatatgaaaaatatggaaacgtgtccgtctttgaaaccactggtggtttggtagtgttctggcaaggtatcaagcaaaaatctctggtggaactcgaacgtttggccaaccgctccagtctgaatcttactcataatagaaccaaaagaagtacagatggcaacaatgcaactcatttatccaacatggaatcggtgcacaatctggtctacgcccagctgcagttcacctatgacacgttgcgcggttacatcaaccgggcgctggcgcaaatcgcagaagcctggtgtgtggatcaacggcgcaccctagaggtcttcaaggaactcagcaagatcaacccgtcagccattctctcggccatttacaacaaaccgattgccgcgcgtttcatgggtgatgtcttgggcctggccagctgcgtgaccatcaaccaaaccagcgtcaaggtgctgcgtgatatgaacgtgaaggagtcgccaggacgctgctactcacgacccgtggtcatctttaatttcgccaacagctcgtacgtgcagtacggtcaactgggcgaggacaacgaaatcctgttgggcaaccaccgcactgaggaatgtcagcttcccagcctcaagatcttcatcgccgggaactcggcctacgagtacgtggactacctcttcaaacgcatgattgacctcagcagtatctccaccgtcgacagcatgatcgccctggatatcgacccgctggaaaataccgacttcagggtactggaactttactcgcagaaagagctgcgttccagcaacgtttttgacctcgaagagatcatgcgcgaattcaactcgtacaagcagcaccatcaccaccatcactgataataggctggagcctcggtggccatgcttcttgccccttgggcctccccccagcccctcctccccttcctgcacccgtacccccgtggtctttgaataaagtctgagtgggcggc

SEQ ID NO: 236 - DNA, 724 bp, Artificial Sequence; identical to SEQ ID NO: 143
  Synthetic polypeptide

SEQ ID NO: 237 - DNA, 748 bp, Artificial Sequence
  Synthetic polypeptide
tcaagcttttggaccctcgtacagaagctaatacgactcactatagggaaataagagagaaaagaagagtaagaagaaatataagagccaccatgagtcccaaagatctgacgccgttcttgacggcgttgtggctgctattgggtcacagccgcgtgccgcgggtgcgcgcagaagaatgttgcgaattcataaacgtcaaccacccgccggaacgctgttacgatttcaaaatgtgcaatcgcttcaccgtcgcgctgcggtgtccggacggcgaagtctgctacagtcccgagaaaacggctgagattcgcgggatcgtcaccaccatgacccattcattgacacgccaggtcgtacacaacaaactgacgagctgcaactacaatccgttatacctcgaagctgacgggcgaatacgctgcggcaaagtaaacgacaaggcgcagtacctgctgggcgccgctggcagcgttccctatcgatggatcaatctggaatacgacaagataacccggatcgtgggcctggatcagtacctggagagcgttaagaaacacaaacggctggatgtgtgccgcgctaaaatgggctatatgctgcaggattacaaggacgatgacgataagtgataataggctggagcctcggtggccatgcttcttgccccttgggcctccccccagcccctcctccccttcctgcacccgtacccccgtggtctttgaataaagtctgagtgggcggc

SEQ ID NO: 238 - DNA, 853 bp, Artificial Sequence
  Synthetic polypeptide
tcaagcttttggaccctcgtacagaagctaatacgactcactatagggaaataagagagaaaagaagagtaagaagaaatataagagccaccatgctgcggcttctgcttcgtcaccactttcactgcctgcttctgtgcgcggtttgggcaacgccctgtctggcgtctccgtggtcgacgctaacagcaaaccagaatccgtccccgccatggtctaaactgacgtattccaaaccgcatgacgcggcgacgttttactgtccttttctctatccctcgcccccacgatcccccttgcaattctcggggttccagcgggtatcaacgggtcccgagtgtcgcaacgagaccctgtatctgctgtacaaccgggaaggccagaccttggtggagagaagctccacctgggtgaaaaaggtgatctggtacctgagcggtcggaaccaaaccatcctccaacggatgccccgaacggcttcgaaaccgagcgacggaaacgtgcagatcagcgtggaagacgccaagatttttggagcgcacatggtgcccaagcagaccaagctgctacgcttcgtcgtcaacgatggcacacgttatcagatgtgtgtgatgaagctggagagctgggctcacgtcttccgggactacagcgtgtcttttcaggtgcgattgacgttcaccgaggccaataaccagacttacaccttctgcacccatcccaatctcatcgtttgataataggctggagcctcggtggccatgcttcttgccccttgggcctccccccagcccctcctccccttcctgcacccgtacccccgtggtctttgaataaagtctgagtgggcggc

SEQ ID NO: 239 - DNA, 880 bp, Artificial Sequence
  Synthetic polypeptide
tcaagcttttggaccctcgtacagaagctaatacgactcactatagggaaataagagagaaaagaagagtaagaagaaatataagagccaccatgctgcggcttctgcttcgtcaccactttcactgcctgcttctgtgcgcggtttgggcaacgccctgtctggcgtctccgtggtcgacgctaacagcaaaccagaatccgtccccgccatggtctaaactgacgtattccaaaccgcatgacgcggcgacgttttactgtccttttctctatccctcgcccccacgatcccccttgcaattctcggggttccagcgggtatcaacgggtcccgagtgtcgcaacgagaccctgtatctgctgtacaaccgggaaggccagaccttggtggagagaagctccacctgggtgaaaaaggtgatctggtacctgagcggtcggaaccaaaccatcctccaacggatgccccgaacggcttcgaaaccgagcgacggaaacgtgcagatcagcgtggaagacgccaagatttttggagcgcacatggtgcccaagcagaccaagctgctacgcttcgtcgtcaacgatggcacacgttatcagatgtgtgtgatgaagctggagagctgggctcacgtcttccgggactacagcgtgtcttttcaggtgcgattgacgttcaccgaggccaataaccagacttacaccttctgcacccatcccaatctcatcgttgattacaaggacgatgacgataagtgatgataataggctggagcctcggtggccatgcttcttgccccttgggcctccccccagcccctcctccccttcctgcacccgtacccccgtggtctttgaataaagtctgagtgggcggc

SEQ ID NO: 240 - DNA, 598 bp, Artificial Sequence
  Synthetic polypeptide
tcaagcttttggaccctcgtacagaagctaatacgactcactatagggaaataagagagaaaagaagagtaagaagaaatataagagccaccatgcggctgtgtcgggtgtggctgtctgtttgtctgtgcgccgtggtgctgggtcagtgccagcgggaaaccgcggaaaaaaacgattattaccgagtaccgcattactgggacgcgtgctctcgcgcgctgcccgaccaaacccgttacaagtatgtggaacagctcgtggacctcacgttgaactaccactacgatgcgagccacggcttggacaactttgacgtgctcaagagaatcaacgtgaccgaggtgtcgttgctcatcagcgactttagacgtcagaaccgtcgcggcggcaccaacaaaaggaccacgttcaacgccgccggttcgctggcgccacacgcccggagcctcgagttcagcgtgcggctctttgccaactgataataggctggagcctcggtggccatgcttcttgccccttgggcctccccccagcccctcctccccttcctgcacccgtacccccgtggtctttgaataaagtctgagtgggcggc

SEQ ID NO: 241 - DNA, 625 bp, Artificial Sequence
  Synthetic polypeptide
tcaagcttttggaccctcgtacagaagctaatacgactcactatagggaaataagagagaaaagaagagtaagaagaaatataagagccaccatgcggctgtgtcgggtgtggctgtctgtttgtctgtgcgccgtggtgctgggtcagtgccagcgggaaaccgcggaaaaaaacgattattaccgagtaccgcattactgggacgcgtgctctcgcgcgctgcccgaccaaacccgttacaagtatgtggaacagctcgtggacctcacgttgaactaccactacgatgcgagccacggcttggacaactttgacgtgctcaagagaatcaacgtgaccgaggtgtcgttgctcatcagcgactttagacgtcagaaccgtcgcggcggcaccaacaaaaggaccacgttcaacgccgccggttcgctggcgccacacgcccggagcctcgagttcagcgtgcggctctttgccaacgattacaaggacgatgacgataagtgatgataataggctggagcctcggtggccatgcttcttgccccttgggcctccccccagcccctcctccccttcctgcacccgtacccccgtggtctttgaataaagtctgagtgggcggc

SEQ ID NO: 242 - DNA, 2434 bp, Artificial Sequence
  Synthetic polypeptide
tcaagcttttggaccctcgtacagaagctaatacgactcactatagggacagacgagagagaagcacgccaattctgcctgcttaagccatgcggccaggcctcccctcctacctcatcatcctcgccgtctgtctcttcagccacctactttcgtcacgatatggcgcagaagccgtatccgaaccgctggacaaagcgtttcacctactgctcaacacctacgggagacccatccgcttcctgcgtgaaaataccacccagtgtacctacaacagcagcctccgtaacagcacggtcgtcagggaaaacgccatcagtttcaactttttccaaagctataatcaatactatgtattccatatgcctcgatgtctttttgcgggtcctctggcggagcagtttctgaaccaggtagatctgaccgaaaccctggaaagataccaacagagacttaacacttacgcgctggtatccaaagacctggccagctaccgatctttttcgcagcagctaaaggcacaagacagcctaggtgaacagcccaccactgtgccaccgcccattgacctgtcaatacctcacgtttggatgccaccgcaaaccactccacacggctggacagaatcacataccacctcaggactacaccgaccacactttaaccagacctgtatcctctttgatggacacgatctactattcagcaccgtcacaccttgtttgcaccaaggcttttacctcatcgacgaactacgttacgttaaaataacactgaccgaggacttcttcgtagttacggtgtccatagacgacgacacacccatgctgcttatcttcggccatcttccacgcgtacttttcaaagcgccctatcaacgcgacaactttatactacgacaaactgaaaaacacgagctcctggtgctagttaagaaagatcaactgaaccgtcactcttatctcaaagacccggactttcttgacgccgcacttgacttcaactacctagacctcagcgcactactacgtaacagctttcaccgttacgccgtggatgtactcaagagcggtcgatgtcagatgctggaccgccgcacggtagaaatggccttcgcctacgcattagcactgttcgcagcagcccgacaagaagaggccggcgcccaagtctccgtcccacgggccctagaccgccaggccgcactcttacaaatacaagaatttatgatcacctgcctctcacaaacaccaccacgcaccacgttgctgctgtatcccacggccgtggacctggccaaacgagccctttggacaccgaatcagatcaccgacatcaccagcctcgtacgcctggtctacatactctctaaacagaatcagcaacatctcatcccccaatgggcactacgacagatcgccgactttgccctaaaactacacaaaacgcacctggcctcttttctttcagccttcgcacgccaagaactctacctcatgggcagcctcgtccactccatgctggtacatacgacggagagacgcgaaatcttcatcgtagaaacgggcctctgttcattggccgagctatcacactttacgcagttgttagctcatccacaccacgaatacctcagcgacctgtacacaccctgttccagtagcgggcgacgcgatcactcgctcgaacgcctcacgcgtctcttccccgatgccaccgtccccgctaccgttcccgccgccctctccatcctatctaccatgcaaccaagcacgctggaaaccttccccgacctgttttgcttgccgctcggcgaatccttctccgcgctgaccgtctccgaacacgtcagttatatcgtaacaaaccagtacctgatcaaaggtatctcctaccctgtctccaccaccgtcgtaggccagagcctcatcatcacccagacggacagtcaaactaaatgcgaactgacgcgcaacatgcataccacacacagcatcacagtggcgctcaacatttcgctagaaaactgcgccttttgccaaagcgccctgctagaatacgacgacacgcaaggcgtcatcaacatcatgtacatgcacgactcggacgacgtccttttcgccctggatccctacaacgaagtggtggtctcatctccgcgaactcactacctcatgcttttgaaaaacggtacggtactagaagtaactgacgtcgtcgtggacgccaccgacagtcgtctcctcatgatgtccgtctacgcgctatcggccatcatcggcatctatctgctctaccgcatgctcaagacatgctgataataggctggagcctcggtggccatgcttcttgccccttgggcctccccccagcccctcctccccttcctgcacccgtacccccgtggtctttgaataaagtctgagtgggcggc

SEQ ID NO: 243 - DNA, 1044 bp, Artificial Sequence
  Synthetic polypeptide
tcaagcttttggaccctcgtacagaagctaatacgactcactatagggcttaagcaggcagaattggcccttagcctgtaccagccgaaccatgtgccgccgcccggattgcggcttctctttctcacctggaccggtgatactgctgtggtgttgccttctgctgcccattgtttcctcagccgccgtcagcgtcgctcctaccgccgccgagaaagtccccgcggagtgccccgaactaacgcgccgatgcttgttgggtgaggtgtttgagggtgacaagtatgaaagttggctgcgcccgttggtgaatgttaccgggcgcgatggcccgctatcgcaacttatccgttaccgtcccgttacgccggaggccgccaactccgtgctgttggacgaggctttcctggacactctggccctgctgtacaacaatccggatcaattgcgggccctgctgacgctgttgagctcggacacagcgccgcgctggatgacggtgatgcgcggctacagcgagtgcggcgatggctcgccggccgtgtacacgtgcgtggacgacctgtgccgcggctacgacctcacgcgactgtcatacgggcgcagcatcttcacggaacacgtgttaggcttcgagctggtgccaccgtctctctttaacgtggtggtggccatacgcaacgaagccacgcgtaccaaccgcgccgtgcgtctgcccgtgagcaccgctgccgcgcccgagggcatcacgctcttttacggcctgtacaacgcagtgaaggaattctgcctgcgtcaccagctggacccgccgctgctacgccacctagataaatactacgccggactgccgcccgagctgaagcagacgcgcgtcaacctgccggctcactcgcgctatggccctcaagcagtggatgctcgctgataataggctggagcctcggtggccatgcttcttgccccttgggcctccccccagcccctcctccccttcctgcacccgtacccccgtggtctttgaataaagtctgagtgggcggc

SEQ ID NO: 244 - DNA, 1045 bp, Artificial Sequence
  Synthetic polypeptide
tcaagcttttggaccctcgtacagaagctaatacgactcactatagggtggctcttatatttcttcttactcttcttttctctcttatttccatgtgccgccgcccggattgcggcttctctttctcacctggaccggtgatactgctgtggtgttgccttctgctgcccattgtttcctcagccgccgtcagcgtcgctcctaccgccgccgagaaagtccccgcggagtgccccgaactaacgcgccgatgcttgttgggtgaggtgtttgagggtgacaagtatgaaagttggctgcgcccgttggtgaatgttaccgggcgcgatggcccgctatcgcaacttatccgttaccgtcccgttacgccggaggccgccaactccgtgctgttggacgaggctttcctggacactctggccctgctgtacaacaatccggatcaattgcgggccctgctgacgctgttgagctcggacacagcgccgcgctggatgacggtgatgcgcggctacagcgagtgcggcgatggctcgccggccgtgtacacgtgcgtggacgacctgtgccgcggctacgacctcacgcgactgtcatacgggcgcagcatcttcacggaacacgtgttaggcttcgagctggtgccaccgtctctctttaacgtggtggtggccatacgcaacgaagccacgcgtaccaaccgcgccgtgcgtctgcccgtgagcaccgctgccgcgcccgagggcatcacgctcttttacggcctgtacaacgcagtgaaggaattctgcctgcgtcaccagctggacccgccgctgctacgccacctagataaatactacgccggactgccgcccgagctgaagcagacgcgcgtcaacctgccggctcactcgcgctatggccctcaagcagtggatgctcgctgataataggctggagcctcggtggccatgcttcttgccccttgggcctccccccagcccctcctccccttcctgcacccgtacccccgtggtctttgaataaagtctgagtgggcggc

SEQ ID NO: 245 - DNA, 722 bp, Artificial Sequence
  Synthetic polypeptide
tcaagcttttggaccctcgtacagaagctaatacgactcactatagggttcggctggtacaggctaaccagaagacagataagagcctccatgagtcccaaagatctgacgccgttcttgacggcgttgtggctgctattgggtcacagccgcgtgccgcgggtgcgcgcagaagaatgttgcgaattcataaacgtcaaccacccgccggaacgctgttacgatttcaaaatgtgcaatcgcttcaccgtcgcgctgcggtgtccggacggcgaagtctgctacagtcccgagaaaacggctgagattcgcgggatcgtcaccaccatgacccattcattgacacgccaggtcgtacacaacaaactgacgagctgcaactacaatccgttatacctcgaagctgacgggcgaatacgctgcggcaaagtaaacgacaaggcgcagtacctgctgggcgccgctggcagcgttccctatcgatggatcaatctggaatacgacaagataacccggatcgtgggcctggatcagtacctggagagcgttaagaaacacaaacggctggatgtgtgccgcgctaaaatgggctatatgctgcagtgataataggctggagcctcggtggccatgcttcttgccccttgggcctccccccagcccctcctccccttcctgcacccgtacccccgtggtctttgaataaagtctgagtgggcggc

SEQ ID NO: 246 - DNA, 853 bp, Artificial Sequence
  Synthetic polypeptide
tcaagcttttggaccctcgtacagaagctaatacgactcactatagggtggctcttatatttcttcttagtccgaattcgaagtacggctacatgctgcggcttctgcttcgtcaccactttcactgcctgcttctgtgcgcggtttgggcaacgccctgtctggcgtctccgtggtcgacgctaacagcaaaccagaatccgtccccgccatggtctaaactgacgtattccaaaccgcatgacgcggcgacgttttactgtccttttctctatccctcgcccccacgatcccccttgcaattctcggggttccagcgggtatcaacgggtcccgagtgtcgcaacgagaccctgtatctgctgtacaaccgggaaggccagaccttggtggagagaagctccacctgggtgaaaaaggtgatctggtacctgagcggtcggaaccaaaccatcctccaacggatgccccgaacggcttcgaaaccgagcgacggaaacgtgcagatcagcgtggaagacgccaagatttttggagcgcacatggtgcccaagcagaccaagctgctacgcttcgtcgtcaacgatggcacacgttatcagatgtgtgtgatgaagctggagagctgggctcacgtcttccgggactacagcgtgtcttttcaggtgcgattgacgttcaccgaggccaataaccagacttacaccttctgcacccatcccaatctcatcgtttgataataggctggagcctcggtggccatgcttcttgccccttgggcctccccccagcccctcctccccttcctgcacccgtacccccgtggtctttgaataaagtctgagtgggcggc

SEQ ID NO: 247 - DNA, 853 bp, Artificial Sequence; identical to SEQ ID NO: 246
  Synthetic polypeptide

SEQ ID NO: 248 - DNA, 597 bp, Artificial Sequence
  Synthetic polypeptide
tcaagcttttggaccctcgtacagaagctaatacgactcactatagggtagccgtacttcgaattcggacaagcttctctctcgtctgtccatgcggctgtgtcgggtgtggctgtctgtttgtctgtgcgccgtggtgctgggtcagtgccagcgggaaaccgcggaaaaaaacgattattaccgagtaccgcattactgggacgcgtgctctcgcgcgctgcccgaccaaacccgttacaagtatgtggaacagctcgtggacctcacgttgaactaccactacgatgcgagccacggcttggacaactttgacgtgctcaagagaatcaacgtgaccgaggtgtcgttgctcatcagcgactttagacgtcagaaccgtcgcggcggcaccaacaaaaggaccacgttcaacgccgccggttcgctggcgccacacgcccggagcctcgagttcagcgtgcggctctttgccaactgataataggctggagcctcggtggccatgcttcttgccccttgggcctccccccagcccctcctccccttcctgcacccgtacccccgtggtctttgaataaagtctgagtgggcggc

SEQ ID NO: 249 - DNA, 597 bp, Artificial Sequence
  Synthetic polypeptide
tcaagcttttggaccctcgtacagaagctaatacgactcactatagggtagccgtacttcgaattcggactttcttttctctcttatttccatgcggctgtgtcgggtgtggctgtctgtttgtctgtgcgccgtggtgctgggtcagtgccagcgggaaaccgcggaaaaaaacgattattaccgagtaccgcattactgggacgcgtgctctcgcgcgctgcccgaccaaacccgttacaagtatgtggaacagctcgtggacctcacgttgaactaccactacgatgcgagccacggcttggacaactttgacgtgctcaagagaatcaacgtgaccgaggtgtcgttgctcatcagcgactttagacgtcagaaccgtcgcggcggcaccaacaaaaggaccacgttcaacgccgccggttcgctggcgccacacgcccggagcctcgagttcagcgtgcggctctttgccaactgataataggctggagcctcggtggccatgcttcttgccccttgggcctccccccagcccctcctccccttcctgcacccgtacccccgtggtctttgaataaagtctgagtgggcggc

SEQ ID NO: 250 - DNA, 3364 bp, Artificial Sequence; identical to SEQ ID NO: 148
  Synthetic polypeptide

SEQ ID NO: 251 - DNA, 3388 bp, Artificial Sequence
  Synthetic polypeptide
tcaagcttttggaccctcgtacagaagctaatacgactcactatagggaaataagagagaaaagaagagtaagaagaaatataagagccaccatggagtcgcgcggtcgccgttgtcccgaaatgatatccgtactgggtcccatttcggggcacgtgctgaaagccgtgtttagtcgcggcgatacgccggtgctgccgcacgagacgcgactcctgcagacgggtatccacgtacgcgtgagccagccctcgctgatcctggtgtcgcagtacacgcccgactcgacgccatgccaccgcggcgacaatcagctgcaggtgcagcacacgtactttacgggcagcgaggtggagaacgtgtcggtcaacgtgcacaaccccacgggccgaagcatctgccccagccaagagcccatgtcgatctatgtgtacgcgctgccgctcaagatgctgaacatccccagcatcaacgtgcaccactacccgtcggcggccgagcgcaaacaccgacacctgcccgtagccgacgctgttattcacgcgtcgggcaagcagatgtggcaggcgcgtctcacggtctcgggactggcctggacgcgtcagcagaaccagtggaaagagcccgacgtctactacacgtcagcgttcgtgtttcccaccaaggacgtggcactgcggcacgtggtgtgcgcgcacgagctggtttgctccatggagaacacgcgcgcaaccaagatgcaggtgataggtgaccagtacgtcaaggtgtacctggagtccttctgcgaggacgtgccctccggcaagctctttatgcacgtcacgctgggctctgacgtggaagaggacctaacgatgacccgcaacccgcaacccttcatgcgcccccacgagcgcaacggctttacggtgttgtgtcccaaaaatatgataatcaaaccgggcaagatctcgcacatcatgctggatgtggcttttacctcacacgagcattttgggctgctgtgtcccaagagcatcccgggcctgagcatctcaggtaacctgttgatgaacgggcagcaaatcttcctggaggtacaagcgatacgcgagaccgtggaactgcgtcagtacgatcccgtggctgcgctcttctttttcgatatcgacttgttgctgcagcgcgggcctcagtacagcgagcaccccaccttcaccagccagtatcgcatccagggcaagcttgagtaccgacacacctgggaccggcacgacgagggtgccgcccagggcgacgacgacgtctggaccagcggatcggactccgacgaagaactcgtaaccaccgagcgtaagacgccccgcgtcaccggcggcggcgccatggcgagcgcctccacttccgcgggccgcaaacgcaaatcagcatcctcggcgacggcgtgcacggcgggcgttatgacacgcggccgccttaaggccgagtccaccgtcgcgcccgaagaggacaccgacgaggattccgacaacgaaatccacaatccggccgtgttcacctggccgccctggcaggccggcatcctggcccgcaacctggtgcccatggtggctacggttcagggtcagaatctgaagtaccaggagttcttctgggacgccaacgacatctaccgcatcttcgccgaattggaaggcgtatggcagcccgctgcgcaacccaaacgtcgccgccaccggcaagacgccttgcccgggccatgcatcgcctcgacgcccaaaaagcaccgaggtgagtcctctgccaagagaaagatggaccctgataatcctgacgagggcccttcctccaaggtgccacggcccgagacacccgtgaccaaggccacgacgttcctgcagactatgttaaggaaggaggttaacagtcagctgagcctgggagacccgctgttcccagaattggccgaagaatccctcaaaacctttgaacaagtgaccgaggattgcaacgagaaccccgaaaaagatgtcctgacagaactcgtcaaacagattaaggttcgagtggacatggtgcggcatagaatcaaggagcacatgctgaaaaaatatacccagacggaagaaaaattcactggcgcctttaatatgatgggaggatgtttgcagaatgccttagatatcttagataaggttcatgagcctttcgaggacatgaagtgtattgggctaactatgcagagcatgtatgagaactacattgtacctgaggataagcgggagatgtggatggcttgtattaaggagctgcatgatgtgagcaagggcgccgctaacaagttggggggtgcactgcaggctaaggcccgtgctaaaaaggatgaacttaggagaaagatgatgtatatgtgctacaggaatatagagttctttaccaagaactcagccttccctaagaccaccaatggctgcagtcaggccatggcggcattgcagaacttgcctcagtgctctcctgatgagattatgtcttatgcccagaaaatctttaagattttggatgaggagagagacaaggtgctcacgcacattgatcacatatttatggatatcctcactacatgtgtggaaacaatgtgtaatgagtacaaggtcactagtgacgcttgtatgatgaccatgtacgggggcatctctctcttaagtgagttctgtcgggtgctgtgctgctatgtcttagaggagactagtgtgatgctggccaagcggcctctgataaccaagcctgaggttatcagtgtaatgaagcgccgcattgaggagatctgcatgaaggtctttgcccagtacattctgggggccgatcctttgagagtctgctctcctagtgtggatgacctacgggccatcgccgaggagtcagatgaggaagaggctattgtagcctacactttggccaccgctggtgccagctcctctgattctctggtgtcacctccagagtcccctgtacccgcgactatccctctgtcctcagtaattgtggctgagaacagtgatcaggaagaaagtgaacagagtgatgaggaacaggaggagggtgctcaggaggagcgggaggacactgtgtctgtcaagtctgagccagtgtctgagatagaggaagttgcctcagaggaagaggaggatggtgctgaggaacccaccgcctctggaggcaagagcacccaccctatggtgactagaagcaaggctgaccaggattacaaggacgatgacgataagtgataataggctggagcctcggtggccatgcttcttgccccttgggcctccccccagcccctcctccccttcctgcacccgtacccccgtggtctttgaataaagtctgagtgggcggc

SEQ ID NO: 252 - DNA, 3352 bp, Artificial Sequence
  Synthetic polypeptide
tcaagcttttggaccctcgtacagaagctaatacgactcactatagggaaataagagagaaaagaagagtaagaagaaatataagagccaccatgcggccaggcctcccctcctacctcatcatcctcgccgtctgtctcttcagccacctactttcgtcacgatatggcgcagaagccgtatccgaaccgctggacaaagcgtttcacctactgctcaacacctacgggagacccatccgcttcctgcgtgaaaataccacccagtgtacctacaacagcagcctccgtaacagcacggtcgtcagggaaaacgccatcagtttcaactttttccaaagctataatcaatactatgtattccatatgcctcgatgtctttttgcgggtcctctggcggagcagtttctgaaccaggtagatctgaccgaaaccctggaaagataccaacagagacttaacacttacgcgctggtatccaaagacctggccagctaccgatctttttcgcagcagctaaaggcacaagacagcctaggtgaacagcccaccactgtgccaccgcccattgacctgtcaatacctcacgtttggatgccaccgcaaaccactccacacggctggacagaatcacataccacctcaggactacaccgaccacactttaaccagacctgtatcctctttgatggacacgatctactattcagcaccgtcacaccttgtttgcaccaaggcttttacctcatcgacgaactacgttacgttaaaataacactgaccgaggacttcttcgtagttacggtgtccatagacgacgacacacccatgctgcttatcttcggccatcttccacgcgtacttttcaaagcgccctatcaacgcgacaactttatactacgacaaactgaaaaacacgagctcctggtgctagttaagaaagatcaactgaaccgtcactcttatctcaaagacccggactttcttgacgccgcacttgacttcaactacctagacctcagcgcactactacgtaacagctttcaccgttacgccgtggatgtactcaagagcggtcgatgtcagatgctggaccgccgcacggtagaaatggccttcgcctacgcattagcactgttcgcagcagcccgacaagaagaggccggcgcccaagtctccgtcccacgggccctagaccgccaggccgcactcttacaaatacaagaatttatgatcacctgcctctcacaaacaccaccacgcaccacgttgctgctgtatcccacggccgtggacctggccaaacgagccctttggacaccgaatcagatcaccgacatcaccagcctcgtacgcctggtctacatactctctaaacagaatcagcaacatctcatcccccaatgggcactacgacagatcgccgactttgccctaaaactacacaaaacgcacctggcctcttttctttcagccttcgcacgccaagaactctacctcatgggcagcctcgtccactccatgctggtacatacgacggagagacgcgaaatcttcatcgtagaaacgggcctctgttcattggccgagctatcacactttacgcagttgttagctcatccacaccacgaatacctcagcgacctgtacacaccctgttccagtagcgggcgacgcgatcactcgctcgaacgcctcacgcgtctcttccccgatgccaccgtccccgctaccgttcccgccgccctctccatcctatctaccatgcaaccaagcacgctggaaaccttccccgacctgttttgcttgccgctcggcgaatccttctccgcgctgaccgtctccgaacacgtcagttatatcgtaacaaaccagtacctgatcaaaggtatctcctaccctgtctccaccaccgtcgtaggccagagcctcatcatcacccagacggacagtcaaactaaatgcgaactgacgcgcaacatgcataccacacacagcatcacagtggcgctcaacatttcgctagaaaactgcgccttttgccaaagcgccctgctagaatacgacgacacgcaaggcgtcatcaacatcatgtacatgcacgactcggacgacgtccttttcgccctggatccctacaacgaagtggtggtctcatctccgcgaactcactacctcatgcttttgaaaaacggtacggtactagaagtaactgacgtcgtcgtggacgccaccgacagtcgtctcctcatgatgtccgtctacgcgctatcggccatcatcggcatctatctgctctaccgcatgctcaagacatgccgcgccaagaggagcggaagcggagctactaacttcagcctgctgaagcaggctggagacgtggaggagaaccctggacctatgtgccgccgcccggattgcggcttctctttctcacctggaccggtgatactgctgtggtgttgccttctgctgcccattgtttcctcagccgccgtcagcgtcgctcctaccgccgccgagaaagtccccgcggagtgccccgaactaacgcgccgatgcttgttgggtgaggtgtttgagggtgacaagtatgaaagttggctgcgcccgttggtgaatgttaccgggcgcgatggcccgctatcgcaacttatccgttaccgtcccgttacgccggaggccgccaactccgtgctgttggacgaggctttcctggacactctggccctgctgtacaacaatccggatcaattgcgggccctgctgacgctgttgagctcggacacagcgccgcgctggatgacggtgatgcgcggctacagcgagtgcggcgatggctcgccggccgtgtacacgtgcgtggacgacctgtgccgcggctacgacctcacgcgactgtcatacgggcgcagcatcttcacggaacacgtgttaggcttcgagctggtgccaccgtctctctttaacgtggtggtggccatacgcaacgaagccacgcgtaccaaccgcgccgtgcgtctgcccgtgagcaccgctgccgcgcccgagggcatcacgctcttttacggcctgtacaacgcagtgaaggaattctgcctgcgtcaccagctggacccgccgctgctacgccacctagataaatactacgccggactgccgcccgagctgaagcagacgcgcgtcaacctgccggctcactcgcgctatggccctcaagcagtggatgctcgctgataataggctggagcctcggtggccatgcttcttgccccttgggcctccccccagcccctcctccccttcctgcacccgtacccccgtggtctttgaataaagtctgagtgggcggc

SEQ ID NO: 253 - DNA, 1924 bp, Artificial Sequence
  Synthetic polypeptide
tcaagcttttggaccctcgtacagaagctaatacgactcactatagggaaataagagagaaaagaagagtaagaagaaatataagagccaccatgagtcccaaagatctgacgccgttcttgacggcgttgtggctgctattgggtcacagccgcgtgccgcgggtgcgcgcagaagaatgttgcgaattcataaacgtcaaccacccgccggaacgctgttacgatttcaaaatgtgcaatcgcttcaccgtcgcgctgcggtgtccggacggcgaagtctgctacagtcccgagaaaacggctgagattcgcgggatcgtcaccaccatgacccattcattgacacgccaggtcgtacacaacaaactgacgagctgcaactacaatccgttatacctcgaagctgacgggcgaatacgctgcggcaaagtaaacgacaaggcgcagtacctgctgggcgccgctggcagcgttccctatcgatggatcaatctggaatacgacaagataacccggatcgtgggcctggatcagtacctggagagcgttaagaaacacaaacggctggatgtgtgccgcgctaaaatgggctatatgctgcagcgcgccaagaggagcggaagcggagctactaacttcagcctgctgaagcaggctggagacgtggaggagaaccctggacctatgctgcggcttctgcttcgtcaccactttcactgcctgcttctgtgcgcggtttgggcaacgccctgtctggcgtctccgtggtcgacgctaacagcaaaccagaatccgtccccgccatggtctaaactgacgtattccaaaccgcatgacgcggcgacgttttactgtccttttctctatccctcgcccccacgatcccccttgcaattctcggggttccagcgggtatcaacgggtcccgagtgtcgcaacgagaccctgtatctgctgtacaaccgggaaggccagaccttggtggagagaagctccacctgggtgaaaaaggtgatctggtacctgagcggtcggaaccaaaccatcctccaacggatgccccgaacggcttcgaaaccgagcgacggaaacgtgcagatcagcgtggaagacgccaagatttttggagcgcacatggtgcccaagcagaccaagctgctacgcttcgtcgtcaacgatggcacacgttatcagatgtgtgtgatgaagctggagagctgggctcacgtcttccgggactacagcgtgtcttttcaggtgcgattgacgttcaccgaggccaataaccagacttacaccttctgcacccatcccaatctcatcgttcgcgccaagaggagcggaagcggagtgaaacagactttgaattttgaccttctcaagttggcgggagacgtggagtccaaccctggacctatgcggctgtgtcgggtgtggctgtctgtttgtctgtgcgccgtggtgctgggtcagtgccagcgggaaaccgcggaaaaaaacgattattaccgagtaccgcattactgggacgcgtgctctcgcgcgctgcccgaccaaacccgttacaagtatgtggaacagctcgtggacctcacgttgaactaccactacgatgcgagccacggcttggacaactttgacgtgctcaagagaatcaacgtgaccgaggtgtcgttgctcatcagcgactttagacgtcagaaccgtcgcggcggcaccaacaaaaggaccacgttcaacgccgccggttcgctggcgccacacgcccggagcctcgagttcagcgtgcggctctttgccaactgataataggctggagcctcggtggccatgcttcttgccccttgggcctccccccagcccctcctccccttcctgcacccgtacccccgtggtctttgaataaagtctgagtgggcggc

SEQ ID NO: 254 - DNA, 5146 bp, Artificial Sequence
  Synthetic polypeptide
tcaagcttttggaccctcgtacagaagctaatacgactcactatagggaaataagagagaaaagaagagtaagaagaaatataagagccaccatgcggccaggcctcccctcctacctcatcatcctcgccgtctgtctcttcagccacctactttcgtcacgatatggcgcagaagccgtatccgaaccgctggacaaagcgtttcacctactgctcaacacctacgggagacccatccgcttcctgcgtgaaaataccacccagtgtacctacaacagcagcctccgtaacagcacggtcgtcagggaaaacgccatcagtttcaactttttccaaagctataatcaatactatgtattccatatgcctcgatgtctttttgcgggtcctctggcggagcagtttctgaaccaggtagatctgaccgaaaccctggaaagataccaacagagacttaacacttacgcgctggtatccaaagacctggccagctaccgatctttttcgcagcagctaaaggcacaagacagcctaggtgaacagcccaccactgtgccaccgcccattgacctgtcaatacctcacgtttggatgccaccgcaaaccactccacacggctggacagaatcacataccacctcaggactacaccgaccacactttaaccagacctgtatcctctttgatggacacgatctactattcagcaccgtcacaccttgtttgcaccaaggcttttacctcatcgacgaactacgttacgttaaaataacactgaccgaggacttcttcgtagttacggtgtccatagacgacgacacacccatgctgcttatcttcggccatcttccacgcgtacttttcaaagcgccctatcaacgcgacaactttatactacgacaaactgaaaaacacgagctcctggtgctagttaagaaagatcaactgaaccgtcactcttatctcaaagacccggactttcttgacgccgcacttgacttcaactacctagacctcagcgcactactacgtaacagctttcaccgttacgccgtggatgtactcaagagcggtcgatgtcagatgctggaccgccgcacggtagaaatggccttcgcctacgcattagcactgttcgcagcagcccgacaagaagaggccggcgcccaagtctccgtcccacgggccctagaccgccaggccgcactcttacaaatacaagaatttatgatcacctgcctctcacaaacaccaccacgcaccacgttgctgctgtatcccacggccgtggacctggccaaacgagccctttggacaccgaatcagatcaccgacatcaccagcctcgtacgcctggtctacatactctctaaacagaatcagcaacatctcatcccccaatgggcactacgacagatcgccgactttgccctaaaactacacaaaacgcacctggcctcttttctttcagccttcgcacgccaagaactctacctcatgggcagcctcgtccactccatgctggtacatacgacggagagacgcgaaatcttcatcgtagaaacgggcctctgttcattggccgagctatcacactttacgcagttgttagctcatccacaccacgaatacctcagcgacctgtacacaccctgttccagtagcgggcgacgcgatcactcgctcgaacgcctcacgcgtctcttccccgatgccaccgtccccgctaccgttcccgccgccctctccatcctatctaccatgcaaccaagcacgctggaaaccttccccgacctgttttgcttgccgctcggcgaatccttctccgcgctgaccgtctccgaacacgtcagttatatcgtaacaaaccagtacctgatcaaaggtatctcctaccctgtctccaccaccgtcgtaggccagagcctcatcatcacccagacggacagtcaaactaaatgcgaactgacgcgcaacatgcataccacacacagcatcacagtggcgctcaacatttcgctagaaaactgcgccttttgccaaagcgccctgctagaatacgacgacacgcaaggcgtcatcaacatcatgtacatgcacgactcggacgacgtccttttcgccctggatccctacaacgaagtggtggtctcatctccgcgaactcactacctcatgcttttgaaaaacggtacggtactagaagtaactgacgtcgtcgtggacgccaccgacagtcgtctcctcatgatgtccgtctacgcgctatcggccatcatcggcatctatctgctctaccgcatgctcaagacatgccgcgccaagaggagcggaagcggagctactaacttcagcctgctgaagcaggctggagacgtggaggagaaccctggacctatgtgccgccgcccggattgcggcttctctttctcacctggaccggtgatactgctgtggtgttgccttctgctgcccattgtttcctcagccgccgtcagcgtcgctcctaccgccgccgagaaagtccccgcggagtgccccgaactaacgcgccgatgcttgttgggtgaggtgtttgagggtgacaagtatgaaagttggctgcgcccgttggtgaatgttaccgggcgcgatggcccgctatcgcaacttatccgttaccgtcccgttacgccggaggccgccaactccgtgctgttggacgaggctttcctggacactctggccctgctgtacaacaatccggatcaattgcgggccctgctgacgctgttgagctcggacacagcgccgcgctggatgacggtgatgcgcggctacagcgagtgcggcgatggctcgccggccgtgtacacgtgcgtggacgacctgtgccgcggctacgacctcacgcgactgtcatacgggcgcagcatcttcacggaacacgtgttaggcttcgagctggtgccaccgtctctctttaacgtggtggtggccatacgcaacgaagccacgcgtaccaaccgcgccgtgcgtctgcccgtgagcaccgctgccgcgcccgagggcatcacgctcttttacggcctgtacaacgcagtgaaggaattctgcctgcgtcaccagctggacccgccgctgctacgccacctagataaatactacgccggactgccgcccgagctgaagcagacgcgcgtcaacctgccggctcactcgcgctatggccctcaagcagtggatgctcgccgcgccaagaggagcggaagcggagtgaaacagactttgaattttgaccttctcaagttggcgggagacgtggagtccaaccctggacctatgagtcccaaagatctgacgccgttcttgacggcgttgtggctgctattgggtcacagccgcgtgccgcgggtgcgcgcagaagaatgttgcgaattcataaacgtcaaccacccgccggaacgctgttacgatttcaaaatgtgcaatcgcttcaccgtcgcgctgcggtgtccggacggcgaagtctgctacagtcccgagaaaacggctgagattcgcgggatcgtcaccaccatgacccattcattgacacgccaggtcgtacacaacaaactgacgagctgcaactacaatccgttatacctcgaagctgacgggcgaatacgctgcggcaaagtaaacgacaaggcgcagtacctgctgggcgccgctggcagcgttccctatcgatggatcaatctggaatacgacaagataacccggatcgtgggcctggatcagtacctggagagcgttaagaaacacaaacggctggatgtgtgccgcgctaaaatgggctatatgctgcagcgcgccaagaggagcggaagcggacagtgtactaattatgctctcttgaaattggctggagatgttgagagcaaccctggacctatgctgcggcttctgcttcgtcaccactttcactgcctgcttctgtgcgcggtttgggcaacgccctgtctggcgtctccgtggtcgacgctaacagcaaaccagaatccgtccccgccatggtctaaactgacgtattccaaaccgcatgacgcggcgacgttttactgtccttttctctatccctcgcccccacgatcccccttgcaattctcggggttccagcgggtatcaacgggtcccgagtgtcgcaacgagaccctgtatctgctgtacaaccgggaaggccagaccttggtggagagaagctccacctgggtgaaaaaggtgatctggtacctgagcggtcggaaccaaaccatcctccaacggatgccccgaacggcttcgaaaccgagcgacggaaacgtgcagatcagcgtggaagacgccaagatttttggagcgcacatggtgcccaagcagaccaagctgctacgcttcgtcgtcaacgatggcacacgttatcagatgtgtgtgatgaagctggagagctgggctcacgtcttccgggactacagcgtgtcttttcaggtgcgattgacgttcaccgaggccaataaccagacttacaccttctgcacccatcccaatctcatcgttcgcgccaagaggagcggaagcggagagggcagaggaagtctgctaacatgcggtgacgtcgaggagaatcctggacctatgcggctgtgtcgggtgtggctgtctgtttgtctgtgcgccgtggtgctgggtcagtgccagcgggaaaccgcggaaaaaaacgattattaccgagtaccgcattactgggacgcgtgctctcgcgcgctgcccgaccaaacccgttacaagtatgtggaacagctcgtggacctcacgttgaactaccactacgatgcgagccacggcttggacaactttgacgtgctcaagagaatcaacgtgaccgaggtgtcgttgctcatcagcgactttagacgtcagaaccgtcgcggcggcaccaacaaaaggaccacgttcaacgccgccggttcgctggcgccacacgcccggagcctcgagttcagcgtgcggctctttgccaactgataataggctggagcctcggtggccatgcttcttgccccttgggcctccccccagcccctcctccccttcctgcacccgtacccccgtggtctttgaataaagtctgagtgggcggc

The invention claimed is:

1. A polypeptide comprising an amino acid sequence set forth in any one of SEQ ID NOs: 2-45 and 47-106.

2. The polypeptide according to claim 1, wherein the sequence comprises SEQ ID NO: 56.

3. The polypeptide according to claim 1, wherein the polypeptide comprises the amino acid sequence set forth in SEQ ID NO: 57.

4. The polypeptide according to claim 1, wherein the sequence comprises SEQ ID NO: 58.

5. The polypeptide according to claim 1, wherein the sequence comprises SEQ ID NO: 75.

6. A polynucleotide encoding a polypeptide comprising an amino acid sequence set forth in any one of SEQ ID Nos: 2-45 and 47-106.

7. A composition comprising a polypeptide of claim 1 and a diluent.

8. The composition according to claim 7, wherein the composition does not comprise a polypeptide having the amino acid sequence set forth in any one of SEQ ID NO: 59, SEQ ID NO: 75, SEQ ID NO: 76, SEQ ID NO: 71, SEQ ID NO: 52, SEQ ID NO: 96, and SEQ ID NO: 50.

9. The composition according to claim 7, further comprising a polypeptide comprising any one amino acid sequence selected from SEQ ID NOS: 211-224.

10. A composition comprising a polynucleotide encoding a polypeptide comprising the sequence selected from any one of SEQ ID Nos: 2-45 and 47-106; and a diluent.

11. The composition according to claim 10, further comprising a polynucleotide comprising a sequence selected from any one of SEQ ID NOS: 141-210.

12. The composition according to claim 10, further comprising a polynucleotide comprising a sequence selected from any one of SEQ ID NOS: 224-254.

13. A method of eliciting an immune response in a mammal, comprising administering an effective amount of a composition comprising a polypeptide comprising the sequence set forth in any one of SEQ ID Nos: 2-45 and 47-106; and a diluent.

14. A method of eliciting an immune response in a mammal, comprising administering an effective amount of a composition comprising a polynucleotide encoding a polypeptide comprising the sequence set forth in any one of SEQ ID Nos: 2-45 and 47-106; and a diluent.

* * * * *